US010864260B2

(12) United States Patent
Regidor Cerrillo et al.

(10) Patent No.: US 10,864,260 B2
(45) Date of Patent: Dec. 15, 2020

(54) *NEOSPORA* VACCINE COMPOSITION

(71) Applicant: UNIVERSIDAD COMPLUTENSE DE MADRID, Madrid (ES)

(72) Inventors: Javier Regidor Cerrillo, Madrid (ES); David Arranz Solís, Madrid (ES); Esther Collantes Fernández, Madrid (ES); Gema Álvarez García, Madrid (ES); Luis Miguel Ortega Mora, Madrid (ES)

(73) Assignee: UNIVERSIDAD COMPLUTENSE DE MADRID, Madrid (ES)

( * ) Notice: Subject to any disclaimer, the term of this patent is extended or adjusted under 35 U.S.C. 154(b) by 0 days.

(21) Appl. No.: 15/771,832

(22) PCT Filed: Oct. 28, 2016

(86) PCT No.: PCT/EP2016/076137
§ 371 (c)(1),
(2) Date: Apr. 27, 2018

(87) PCT Pub. No.: WO2017/072325
PCT Pub. Date: May 4, 2017

(65) Prior Publication Data
US 2018/0311332 A1 Nov. 1, 2018

(30) Foreign Application Priority Data
Oct. 28, 2015 (EP) ..................................... 15382532

(51) Int. Cl.
| | | |
|---|---|---|
| *A61K 39/002* | (2006.01) | |
| *A61K 39/012* | (2006.01) | |
| *C07K 14/44* | (2006.01) | |
| *C12N 1/10* | (2006.01) | |
| *A61P 33/02* | (2006.01) | |
| *A61K 39/00* | (2006.01) | |

(52) U.S. Cl.
CPC .......... *A61K 39/012* (2013.01); *A61K 39/002* (2013.01); *A61P 33/02* (2018.01); *C07K 14/44* (2013.01); *C12N 1/10* (2013.01); *A61K 2039/552* (2013.01); *A61K 2039/55577* (2013.01); *A61K 2039/70* (2013.01); *Y02A 50/412* (2018.01)

(58) Field of Classification Search
None
See application file for complete search history.

(56) References Cited

U.S. PATENT DOCUMENTS

| | | |
|---|---|---|
| 5,240,704 A | 8/1993 | Tsurumizu et al. |
| 5,707,617 A | 1/1998 | Conrad et al. |
| 2009/0208519 A1 | 8/2009 | Tuo et al. |

FOREIGN PATENT DOCUMENTS

| | | |
|---|---|---|
| CR | 6773 A | 5/2006 |
| EP | 0 841 392 A2 | 5/1998 |
| EP | 0 898 969 A2 | 3/1999 |
| WO | 99/20303 A1 | 4/1999 |
| WO | 2004/026903 A2 | 4/2004 |

OTHER PUBLICATIONS

Crapo et al., "An overview of tissue and whole organ decellularization processes," *Biomaterials* 32:3233-3243 (2011).
Hecker et al., "Immune response and protection provided by live tachyzoites and native antigens from the NC-6 Argentina strain of *Neospora caninum* in pregnant heifers," *Veterinary Parasitology* 197:436-446 (2013).
Mansilla et al., "Dose-dependent immunogenicity of a soluble *Neospora caninum* tachyzoite-extract vaccine formulated with a soy lecithin/ β-glucan adjuvant in cattle," *Veterinary Parasitology* 197:13-21 (2013).
Álvarez-Garcia et al., "Influence of age and purpose for testing on the cut-off selection of serological methods in bovine neosporosis," *Vet. Res.* 34:341-352, 2003.
Andrianarivo et al., "Immunogenicity of a killed whole *Neospora caninum* tachyzoite preparation formulated with different adjuvants," *International Journal for Parasitology* 29:1613-1625, 1999.
Andrianarivo et al., "A POLYGEN™-adjuvanted killed *Neospora caninum* tachyzoite preparation failed to prevent foetal infection in pregnant cattle following i.v./i.m. experimental tachyzoite challenge," *International Journal for Parasitology* 30:985-990, 2000.
Dubey et al., "Epidemiology and Control of Neosporosis and *Neospora caninum*," *Clinical Microbiology Reviews* 20(2):323-367, 2007.
Regidor-Cerrillo et al., "Isolation and genetic characterization of *Neospora caninum* from asymptomatic calves in Spain," *Parasitology* 135:1651-1659, 2008.
Reichel et al., "If control of *Neospora caninum* infection is technically feasible does it make economic sense?" *Veterinary Parasitology* 142:23-34, 2006.
Reichel et al., "Control options for *Neospora caninum*—is there anything new or are we going backwards?" *Parasitology*, Special Issue Article, pp. 1-16, 2014.
Reichel et al., "A live vaccine against *Neospora caninum* abortions in cattle," *Vaccine* 33:1299- 1301, 2015.

(Continued)

*Primary Examiner* — Jennifer E Graser
(74) *Attorney, Agent, or Firm* — Seed Intellectual Property Law Group LLP

(57) ABSTRACT

The present invention relates to new protein compositions, methods for producing said protein compositions, pharmaceutical compositions comprising said protein compositions and methods for treating infections caused by *Neospora caninum*. In particular, the present invention relates to a protein composition comprising the proteins specified in Table A in an amount of at least about 2 times (fold change) higher than the same protein present in the whole tachyzoite, as calculated by quantitative label-free liquid chromatography-tandem mass spectrometry (LC-MS/MS).

16 Claims, 7 Drawing Sheets
Specification includes a Sequence Listing.

(56) References Cited

OTHER PUBLICATIONS

Romero et al., "Effect of a killed whole *Neospora caninum* tachyzoite vaccine on the crude abortion rate of Costa Rican dairy cows under field conditions," *Veterinary Parasitology* 123:149-159, 2004.
Spickler et al., "Adjuvants in Veterinary Vaccines: Modes of Action and Adverse Effects," *J. Vet. Intern. Med.* 17:273-281, 2003.
Sun et al., "Advances in saponin-based adjuvants," *Vaccine* 27:1787-1796, 2009.

NEOSPORA VACCINE COMPOSITION

FIELD OF THE INVENTION

The present invention relates to the field of protein compositions, in particular to the field of vaccines. The present invention relates to new protein compositions, methods for producing said protein compositions, pharmaceutical compositions comprising said protein compositions and methods for treating infections caused by *Neospora caninum*.

BACKGROUND OF THE INVENTION

*Neospora caninum* is a parasite belonging to the phylum Apicomplexa in which the genera *Plasmodium, Babesia, Cryptosporidium, Eimeria* and *Toxoplasma* are grouped, which include some of the most important disease-causing organisms known to man and animals. *N. caninum* was first described in 1984 as a protozoan able to cause encephalitis and myositis in dogs, and shortly thereafter it was recognized as an abortion- and neonatal mortality-causing agent in cattle. Infections caused by the parasite in other hosts, including several hoofed animals and canines, have also been described in recent years. However, the importance of neosporosis in cattle and dogs stands out (Dubey et al., 2006, J. Comp. Path. 134: 267-289; Dubey et al., 2007, Clinical Microbiology Reviews 20, 323-367).

Until now three stages in the biological cycle of *N. caninum* have been described: sporozoites, developed in the oocysts shed in the feces of the definitive host (canines), are able to infect the intermediate host (cattle and other ungulates); tachyzoites, the fast multiplication form, responsible for the acute phase of the infection and its propagation to other tissues; and bradyzoites, the slow multiplication stage of the parasite giving rise to tissue cysts where the parasite remains quiescent during the chronic phase until its reactivation.

Bovine neosporosis is considered a parasitic disease with cosmopolitan distribution and one of the most frequent causes of reproductive failure in cattle in several producing countries in which it has been studied, including Spain, leading to significant economic losses in beef and dairy cattle industries (Dubey et al., 2007, Clinical Microbiology Reviews 20, 323-367; Reichel et al., 2013, Int. J. Parasitol. 43(2):133-142). The most important clinical manifestation of the infection is abortion, which generally takes place between the fifth and seventh month of gestation. Furthermore, born live infected calves may have neuromuscular problems up to two months post-partum. However, the most frequent manifestation is the birth of clinically healthy but chronically infected calves. With respect to the transmission of the disease, the fundamental route is endogenous transplacental infection, although the involvement of horizontal transmission has also been demonstrated (Trees & Williams, 2005, Trends Parasitol. 21 (12): 558-561; Dubey et al., 2006, J. Comp. Path. 134: 267-289; Dubey et al., 2007, Clinical Microbiology Reviews 20, 323-367).

Epidemiological evidence confirming the protective immunity against vertical transmission and abortion in some *N. caninum*-infected cows makes immunoprophylaxis a feasible alternative for control of the disease (Reichel and Ellis, 2006, Veterinary Parasitology 142, 23-34; Dubey et al., 2007, Clinical Microbiology Reviews 20, 323-367; Reichel et al., 2014, Parasitology 141(11):1455-1470).

Studies conducted for the development of vaccines for the protection against neosporosis have included the evaluation of inactivated vaccines (such as those described in EP0898969 and WO99/20303), attenuated vaccines (as described e.g. in EP0841392 and WO2004/026903), vaccines developed from recombinant antigenic proteins and DNA vaccines with variable results. One of the few studies performed in bovines demonstrated that the vaccine developed from killed tachyzoites emulsified with the adjuvant POLYGEN™, described in WO99/20303, was able to elicit a slight immune cell response (Andrianarivo et al., 1999, Int. J. Parasitol. 29, 1613-1625), although it was unable to protect against fetal infection in dams (Andrianarivo et al., 2000, Int J Parasitol. 30(9): 985-90). A commercially available inactivated vaccine for the prevention of bovine neosporosis has been recently withdrawn from the market, presumably due to its very low efficacy in field trials (Reichel et al., 2015, Vaccine 33(11):1299-1301).

Therefore, there is still an urgent need for a more efficient vaccine for the protection against neosporosis.

BRIEF DESCRIPTION OF THE INVENTION

A first aspect of the present invention relates to a protein composition, comprising (or, alternatively, consisting of) at least one, and preferably all, of the following proteins in an amount of at least about 2 times (fold change) higher than the same protein present in the whole tachyzoite extract (WTE), as assessed by quantitative label-free liquid chromatography tandem mass spectrometry (LC-MS/MS) analysis (TABLE A):

TABLE A

| Accession number[1] | Description[2] |
|---|---|
| NCLIV_018120 | conserved hypothetical protein |
| NCLIV_003410 | putative HECT-domain (ubiquitin-transferase) containing protein |
| NCLIV_058550 | conserved hypothetical protein |
| NCLIV_042610 | conserved hypothetical protein |
| NCLIV_032910 | hypothetical protein |
| NCLIV_024830 | conserved hypothetical protein |
| NCLIV_015180 | ATP synthase, related |
| NCLIV_066970 | putative enoyl-acyl carrier reductase |
| NCLIV_025730 | conserved hypothetical protein |
| NCLIV_006640 | hypothetical protein |
| NCLIV_003470 | putative thrombospondin type 1 domain-containing protein |
| NCLIV_019000 | putative adenosine transporter |
| NCLIV_054510 | putative heat shock protein 90 |
| NCLIV_066350 | Os06g0732000 protein, related |
| NCLIV_057020 | conserved hypothetical protein |
| NCLIV_056680 | hypothetical protein |

TABLE A-continued

| Accession number[1] | Description[2] |
|---|---|
| NCLIV_044290 | pyruvate dehydrogenase E2 component, related |
| NCLIV_032030 | conserved hypothetical protein |
| NCLIV_052240 | putative saccharopine dehydrogenase |
| NCLIV_008730 | hypothetical protein |
| NCLIV_061830 | 60S acidic ribosomal protein P0 |
| NCLIV_002770 | putative MORN repeat-containing protein |
| NCLIV_014760 | conserved hypothetical protein |
| NCLIV_054520 | hypothetical protein |
| NCLIV_033810 | hypothetical protein |
| NCLIV_043330 | hypothetical protein |
| NCLIV_000430 | conserved hypothetical protein |
| NCLIV_030860 | conserved hypothetical protein |
| NCLIV_048570 | conserved hypothetical protein |
| NCLIV_004190 | putative thioredoxin |
| NCLIV_019450 | hypothetical protein |
| NCLIV_027160 | conserved hypothetical protein |
| NCLIV_044600 | conserved hypothetical protein |
| NCLIV_000300 | conserved hypothetical protein |
| NCLIV_046830 | putative ATP synthase |
| NCLIV_004280 | hypothetical protein |
| NCLIV_006720 | conserved hypothetical protein |
| NCLIV_046800 | putative AGC kinase |
| NCLIV_051960 | conserved hypothetical protein |
| NCLIV_010600 | putative microneme protein MIC3 |
| NCLIV_015920 | Histone H4, related |
| NCLIV_012830 | putative MORN repeat-containing protein |
| NCLIV_0376 | elongation factor Tu GTP-binding domain-containing protein |
| NCLIV_024420 | hypothetical protein |
| NCLIV_036130 | CBR-RSP-4 protein, related |
| NCLIV_036400 | unspecified product |
| NCLIV_006780 | conserved hypothetical protein |
| NCLIV_046940 | putative PWWP domain-containing protein |
| NCLIV_001370 | putative DEAD/DEAH box helicase |
| NCLIV_001300 | putative calmodulin |
| NCLIV_015380 | conserved hypothetical protein |
| NCLIV_038990 | conserved hypothetical protein |
| NCLIV_043110 | putative interferon gamma-inducible protein 30 |

[1]Accession number for the identified protein in ToxoDB database (ToxoDB-13.0_NcaninumLIV_AnnotatedProteins; 7122 sequences; Date Feb. 9, 2015) (Gajria et al., 2008, Nucleic Acids Res. 36; Database issue: D553-556).
[2]Protein description in ToxoDB database (ToxoDB-13.0_NcaninumLIV_AnnotatedProteins; 7122 sequences; Date Feb. 9, 2015) (Gajria et al., 2008, Nucleic Acids Res. 36; Database issue: D553-556)

wherein the WTE is prepared as described in Example 4 of the present description, and wherein the quantitative label-free LC-MS/MS analysis is performed as described in Example 4 of the present description.

A second aspect of the present invention refers to a method for producing a protein composition comprising the following steps:
a. Providing *Neospora caninum* tachyzoites in an hypertonic solution;
b. Centrifuging said solution obtained in step (a) under conditions suitable for separating the soluble fraction (supernatant) and insoluble fraction (precipitate);
c. Recovering the precipitate from step (b); and
d. Mixing said precipitate with a non-ionic surfactant.

The present invention further provides a protein composition (directly) obtainable or obtained by the method according to the present invention.

The present invention further provides a pharmaceutical composition (or pharmaceutical formula) comprising the protein composition of the present invention. In one embodiment, the pharmaceutical composition of the invention is a vaccine.

DETAILED DESCRIPTION OF THE INVENTION

Figure 1:
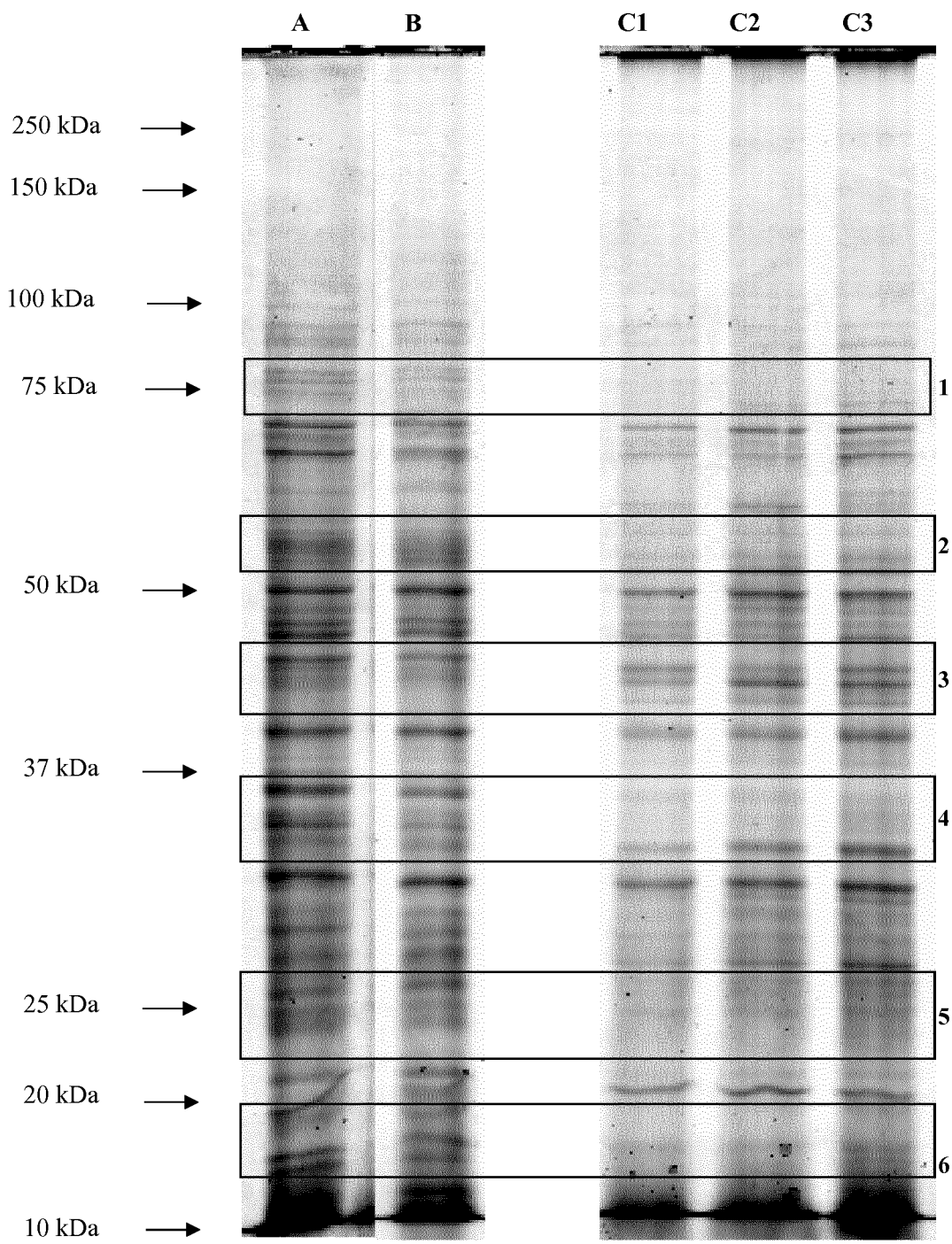
FIG. 1: Coomassie stained SDS-PAGE gel with the whole tachyzoite (whole tachyzoite sample, "WTS") (A), soluble extract (B) and 3 replicates of the enriched antigen extract (EAE) from different production batches (C1, C2 and C3). Arrows highlight molecular weight standards with molecular masses in kDa. Boxes delimit regions of the protein pattern with differentiation between extracts: box 1 delimits the 80 kDa and 70 kDa region; box 2, the 60 kDa and 50 kDa region; box 3, the 45 kDa and 40 kDa region; box 4, the 37 and 32 kDa region; box 5, the 26 kDa and 22 kDa region and box 6, the 20 kDa and 13 kDa region.

The inventors have identified a new protein composition which is described below.

Protein Composition of the Present Invention

A first aspect of the present invention relates to a protein composition comprising at least one, and preferably all, of the proteins of TABLE A (as described above in this description) in an amount of at least about 2 times (fold change) higher than the same protein present in the whole tachyzoite (also referred to in the present specification as "whole tachyzoite extract", or "WTE"), determined by quantitative label-free LC-MS/MS analysis.

The whole tachyzoite extract (WTE) with which the amount of protein of the composition of the present invention is compared is prepared as in Example 4 of the present specification (e.g., Example 4.1.1. (*Neospora caninum* cultures, tachyzoite production for EAE and WTE, and EAE and WTE production). The WTE is obtained from *Neospora caninum* tachyzoites growth in cell cultures as follows: Tachyzoites of the Nc-Spain 7 isolate (deposited on 20 Sep. 2005, by Prof. Luis Miguel Ortega Mora, Grupo de salud veterinaria y zoonosis, Departamento de sanidad animal—Facultad de veterinaria, Universidad Complutense de Madrid, Avenida Puerta de Hierro S/N, Ciudad Universitaria, 28040, Madrid, according to the provisions of the Budapest Treaty on the International Recognition of the Deposit of Microorganisms for the Purposes of Patent Procedure, in the Culture Collection of Algae and Protozoa (CCAP) located in the Dunstaffnage Marine Laboratory, Dunbeg, OBAN, Argyll PA37 1QA, United Kingdom, with accession number CCAP 2051/1) (although *N. caninum* tachyzoites of any other isolate may equally be employed) were maintained in MARC-145 monkey kidney cell monolayers (USDA, ARS, Clay Center, Ne, USA) by successive passages at 3-4 day intervals following standard procedures (Regidor-Cerrillo et al., 2010. Vet Res. 41: 52). For each culture passage, tachyzoites were recovered from cultures by cell scraping, passaged by 25G needle and inoculated onto a fresh MARC-145 monolayer in Dulbecco's Minimum Essential Medium (DMEM) supplemented with 1% (v/v) antibiotic-antimycotic solution (Gibco BRL, Paisley, UK) and 2% (v/v) foetal bovine serum and incubated at 37° C. in 5% $CO_2$. The tachyzoites for the extract were recovered from the culture after a lack of cellular lysis in 80% of the infected cells and, preferably, in 90-100% of the infected cells, confirmed by visualization in an inverted optical microscope of 400×, where the number of lysis plates caused by the liberation of the parasite and the number of cells with vacuoles originated from parasites in a minimum of five different fields was microscopically examined. The cell layer was mechanically detached from flasks using a cell scraper, recovered by centrifugation at 4° C. (1350×g, 15 min) and re-suspended in a phosphate buffer solution (PBS, pH 7.4). To purify the tachyzoites, the suspension was passed through a 25 G needle for releasing tachyzoites and, afterwards, the suspension was passed through Sephadex G-25 PD10 chromatographic columns (GE Healthcare) for separating tachyzoites from cell debris, as described by Hemphill, 1996 (Hemphill, 1996. Infect. Immun. 64, 4279-4287). The number of total eluted and viable purified tachyzoites was determined in the eluent of the columns by counting in the Neubauer chamber. All batches of purified tachyzoites showed a viability >90%. Purified tachyzoites were centrifuged (1350×g, 15 min, 4° C.) and the supernatant was discarded. Tachyzoites were kept at −80° C. until they were processed for the preparation (production) of the extract.

For WTE, frozen tachyzoites (prepared as described above) were directly resuspended in 1% Triton-X 100 (v/v) solution with protease inhibitor cocktail (Sigma-Aldrich) and shaked overnight at 4° C. As the skilled person knows, a protease inhibitor cocktail has the function of inhibiting the protease degradation of the proteins present in a protein composition. The presence of protease inhibitors in a composition does not generate differences in, for example, the results obtained in LC-MS/MS. On the contrary, the presence of protease inhibitors in a composition helps to avoid alterations in the protein composition. As the skilled person may understand, any suitable protease inhibitor may be used for this purpose.

The extract preparation for LC-MS/MS experiments and the analyses are described in Example 4 of the present specification (Examples 4.1.2. (Sample preparation for LC-MS/MS experiments), 4.1.3. (Liquid Chromatography Tandem Mass Spectrometry (LC-MS/MS)), 4.1.4. (Peptide Identification by Mascot Database Searches), 4.1.5. (Protein relative quantification), 4.1.6. (In Silico analysis of diferentially abundant identified proteins) and 4.2.2 (Relative quantification between EAE and WTE). The procedures, conditions, apparatuses and databases described in the above examples are preferably used in the present invention.

The protein composition of the present invention comprises (or, alternatively, consists of) at least one such as 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53 of the proteins as listed in Table A above in an amount of at least about 2 times (fold change) higher than the same protein present in the WTE, as determined by relative quantification by quantitative label-free LC-MS/MS analysis. Preferably, the protein composition of the present invention comprises (or, alternatively, consists of) at least 5, more preferably at least 10, even more preferably at least 25, or at least 50 of the proteins as listed in Table A above in an amount of at least about 2 times (fold change) higher than the same protein present in the WTE, as determined by relative quantification by quantitative label-free LC-MS/MS analysis.

Even more preferably, the protein composition of the present invention comprises (or, alternatively, consists of) all of the proteins as listed in Table A above in an amount of at least about 2 times (fold change) higher than the same protein present in the WTE, as determined by relative quantification by quantitative label-free LC-MS/MS analysis.

As used herein, the term "about" means the indicated value±1% of its value, or the term "about" means the indicated value±2% of its value, or the term "about" means the indicated value±5% of its value, the term "about" means the indicated value±10% of its value, or the term "about" means the indicated value±20% of its value, or the term "about" means the indicated value±30% of its value; preferably the term "about" means exactly the indicated value (±0%).

Preferably, the protein composition of the invention comprises (or, alternatively, consists of) at least one, and preferably all, of following proteins in an amount defined as indicated in the column "fold change" in the below table (Table B) higher than the same protein present in the WTE, as determined by relative quantification by quantitative label-free LC-MS/MS analysis:

TABLE B

| Accession number[1] | Fold change | Description[2] |
|---|---|---|
| NCLIV_018120 | about 4.15 | conserved hypothetical protein |
| NCLIV_003410 | about 3.35 | putative HECT-domain (ubiquitin-transferase) containing protein |
| NCLIV_058550 | about 3.33 | conserved hypothetical protein |
| NCLIV_042610 | about 3.06 | conserved hypothetical protein |
| NCLIV_032910 | about 2.99 | hypothetical protein |
| NCLIV_024830 | about 2.7 | conserved hypothetical protein |
| NCLIV_015180 | about 2.52 | ATP synthase, related |
| NCLIV_066970 | about 2.48 | putative enoyl-acyl carrier reductase |
| NCLIV_025730 | about 2.47 | conserved hypothetical protein |
| NCLIV_006640 | about 2.42 | hypothetical protein |
| NCLIV_003470 | about 2.39 | putative thrombospondin type 1 domain-containing protein |
| NCLIV_019000 | about 2.37 | putative adenosine transporter |
| NCLIV_054510 | about 2.36 | putative heat shock protein 90 |
| NCLIV_066350 | about 2.35 | Os06g0732000 protein, related |
| NCLIV_057020 | about 2.32 | conserved hypothetical protein |
| NCLIV_056680 | about 2.3 | hypothetical protein |
| NCLIV_044290 | about 2.29 | pyruvate dehydrogenase E2 component, related |
| NCLIV_032030 | about 2.27 | conserved hypothetical protein |
| NCLIV_052240 | about 2.27 | putative saccharopine dehydrogenase |
| NCLIV_008730 | about 2.22 | hypothetical protein |
| NCLIV_061830 | about 2.22 | 60S acidic ribosomal protein P0 |
| NCLIV_002770 | about 2.18 | putative MORN repeat-containing protein |
| NCLIV_014760 | about 2.17 | conserved hypothetical protein |
| NCLIV_054520 | about 2.17 | hypothetical protein |

TABLE B-continued

| Accession number[1] | Fold change | Description[2] |
|---|---|---|
| NCLIV_033810 | about 2.16 | hypothetical protein |
| NCLIV_043330 | about 2.16 | hypothetical protein |
| NCLIV_000430 | about 2.15 | conserved hypothetical protein |
| NCLIV_030860 | about 2.14 | conserved hypothetical protein |
| NCLIV_048570 | about 2.14 | conserved hypothetical protein |
| NCLIV_004190 | about 2.13 | putative thioredoxin |
| NCLIV_019450 | about 2.13 | hypothetical protein |
| NCLIV_027160 | about 2.13 | conserved hypothetical protein |
| NCLIV_044600 | about 2.13 | conserved hypothetical protein |
| NCLIV_000300 | about 2.12 | conserved hypothetical protein |
| NCLIV_046830 | about 2.12 | putative ATP synthase |
| NCLIV_004280 | about 2.11 | hypothetical protein |
| NCLIV_006720 | about 2.1 | conserved hypothetical protein |
| NCLIV_046800 | about 2.1 | putative AGC kinase |
| NCLIV_051960 | about 2.1 | conserved hypothetical protein |
| NCLIV_010600 | about 2.09 | putative microneme protein MIC3 |
| NCLIV_015920 | about 2.09 | Histone H4, related |
| NCLIV_012830 | about 2.08 | putative MORN repeat-containing protein |
| NCLIV_0376 | about 2.08 | elongation factor Tu GTP-binding domain-containing protein |
| NCLIV_024420 | about 2.06 | hypothetical protein |
| NCLIV_036130 | about 2.06 | CBR-RSP-4 protein, related |
| NCLIV_036400 | about 2.06 | unspecified product |
| NCLIV_006780 | about 2.04 | conserved hypothetical protein |
| NCLIV_046940 | about 2.04 | putative PWWP domain-containing protein |
| NCLIV_001370 | about 2.03 | putative DEAD/DEAH box helicase |
| NCLIV_001300 | about 2.02 | putative calmodulin |
| NCLIV_015380 | about 2.02 | conserved hypothetical protein |
| NCLIV_038990 | about 2 | conserved hypothetical protein |
| NCLIV_043110 | about 2 | putative interferon gamma-inducible protein 30 |

[1]Accesion number for the identified proteins in ToxoDB database (ToxoDB-13.0_NcaninumLIV_AnnotatedProteins; 7122 sequences; Date Feb. 9, 2015) (Gajria et al., 2008, Nucleic Acids Res. 36; Database issue: D553-556).
[2]Protein description in ToxoDB database (ToxoDB-13.0_NcaninumLIV_AnnotatedProteins; 7122 sequences; Date Feb. 9, 2015) (Gajria et al., 2008, Nucleic Acids Res. 36; Database issue: D553-556).

The WTE with which the amount of protein of the composition of the present invention is compared is prepared as in Example 4 of the present specification (Example 4.1.1. (*Neospora caninum* cultures, tachyzoite production for EAE and WTE, and EAE and WTE production).

The extract preparation for LC-MS/MS experiments and the analyses are described in Example 4 of the present specification (Examples 4.1.2. (Sample preparation for LC-MS/MS experiments), 4.1.3. (Liquid Chromatography Tandem Mass Spectrometry (LC-MS/MS)), 4.1.4. (Peptide Identification by Mascot Database Searches), 4.1.5. (Protein relative quantification), 4.1.6. (In Silico analysis of diferentially abundant identified proteins) and 4.2.2 (Relative quantification between EAE and WTE)). The procedures, conditions, apparatuses and databases described in the above examples are preferably used in the context of the present invention.

The protein composition of the present invention comprises (or, alternatively, consists of) at least one such as 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53 of the proteins as listed in Table B above in an amount defined as indicated in the column "fold change" in Table B higher than the same protein present in the WTE, as determined by relative quantification by quantitative label-free LC-MS/MS analysis. Preferably, the protein composition of the present invention comprises (or, alternatively, consists of) at least 5, more preferably at least 10, even more preferably at least 25, or at least 50 of the proteins as listed in Table B above in an amount defined as indicated in the column "fold change" in Table B higher than the same protein present in the WTE, as determined by relative quantification by quantitative label-free LC-MS/MS analysis.

Even more preferably, the protein composition of the present invention comprises (or, alternatively, consists of) all of the proteins as listed in Table B above in an amount defined as indicated in the column "fold change" in Table B higher than the same protein present in the WTE, as determined by relative quantification by quantitative label-free LC-MS/MS analysis.

Preferably, the protein composition of the present invention comprises (or, alternatively, consists of) at least one, and preferably all, of the following proteins in an amount of at least about 1.5 times (fold change, (ANOVA, p<0.05)) higher than the same protein present in the whole tachyzoite extract (also referred to in the present specification as "WTE"), as determined by relative quantification by quantitative label-free LC-MS/MS analysis:

TABLE C

| Accession number[1] | Description[2] |
|---|---|
| NCLIV_018120 | conserved hypothetical protein |
| NCLIV_003410 | putative HECT-domain (ubiquitin-transferase) containing protein |
| NCLIV_058550 | conserved hypothetical protein |
| NCLIV_042610 | conserved hypothetical protein |
| NCLIV_032910 | hypothetical protein |
| NCLIV_024830 | conserved hypothetical protein |
| NCLIV_015180 | ATP synthase, related |

TABLE C-continued

| Accession number[1] | Description[2] |
|---|---|
| NCLIV_066970 | putative enoyl-acyl carrier reductase |
| NCLIV_025730 | conserved hypothetical protein |
| NCLIV_006640 | hypothetical protein |
| NCLIV_003470 | putative thrombospondin type 1 domain-containing protein |
| NCLIV_019000 | putative adenosine transporter |
| NCLIV_054510 | putative heat shock protein 90 |
| NCLIV_066350 | Os06g0732000 protein, related |
| NCLIV_057020 | conserved hypothetical protein |
| NCLIV_056680 | hypothetical protein |
| NCLIV_044290 | pyruvate dehydrogenase E2 component, related |
| NCLIV_032030 | conserved hypothetical protein |
| NCLIV_052240 | putative saccharopine dehydrogenase |
| NCLIV_008730 | hypothetical protein |
| NCLIV_061830 | 60S acidic ribosomal protein P0 |
| NCLIV_002770 | putative MORN repeat-containing protein |
| NCLIV_014760 | conserved hypothetical protein |
| NCLIV_054520 | hypothetical protein |
| NCLIV_033810 | hypothetical protein |
| NCLIV_043330 | hypothetical protein |
| NCLIV_000430 | conserved hypothetical protein |
| NCLIV_030860 | conserved hypothetical protein |
| NCLIV_048570 | conserved hypothetical protein |
| NCLIV_004190 | putative thioredoxin |
| NCLIV_019450 | hypothetical protein |
| NCLIV_027160 | conserved hypothetical protein |
| NCLIV_044600 | conserved hypothetical protein |
| NCLIV_000300 | conserved hypothetical protein |
| NCLIV_046830 | putative ATP synthase |
| NCLIV_004280 | hypothetical protein |
| NCLIV_006720 | conserved hypothetical protein |
| NCLIV_046800 | putative AGC kinase |
| NCLIV_051960 | conserved hypothetical protein |
| NCLIV_010600 | putative microneme protein MIC3 |
| NCLIV_015920 | Histone H4, related |
| NCLIV_012830 | putative MORN repeat-containing protein |
| NCLIV_0376 | elongation factor Tu GTP-binding domain-containing protein |
| NCLIV_024420 | hypothetical protein |
| NCLIV_036130 | CBR-RSP-4 protein, related |
| NCLIV_036400 | unspecified product |
| NCLIV_006780 | conserved hypothetical protein |
| NCLIV_046940 | putative PWWP domain-containing protein |
| NCLIV_001370 | putative DEAD/DEAH box helicase |
| NCLIV_001300 | putative calmodulin |
| NCLIV_015380 | conserved hypothetical protein |
| NCLIV_038990 | conserved hypothetical protein |
| NCLIV_043110 | putative interferon gamma-inducible protein 30 |
| NCLIV_004750 | putative peptidase family M48 domain-containing protein |
| NCLIV_025000 | hypothetical protein |
| NCLIV_041790 | conserved hypothetical protein |
| NCLIV_058420 | conserved hypothetical protein |
| NCLIV_015430 | hypothetical protein |
| NCLIV_023620 | SRS domain-containing protein |
| NCLIV_049050 | RNA helicase-related protein required for pre-mRNA splicing, related |
| NCLIV_029420 | putative myosin light chain TgMLC1 |
| NCLIV_010320 | putative dihydrolipoamide branched chain transacylase, E2 subunit |
| NCLIV_006060 | conserved hypothetical protein |
| NCLIV_032810 | conserved hypothetical protein |
| NCLIV_004860 | hypothetical protein |
| NCLIV_007260 | putative p97 protein |
| NCLIV_026590 | putative DEAD/DEAH box helicase |
| NCLIV_054540 | RAB5C, member RAS oncogene family, related |
| NCLIV_0153 | longevity-assurance (LAG1) domain-containing protein |
| NCLIV_030420 | Ren2-prov protein, related |
| NCLIV_051920 | conserved hypothetical protein |
| NCLIV_065970 | conserved hypothetical protein |
| NCLIV_026430 | DnaJ domain containing protein, related |
| NCLIV_061160 | putative acid phosphatase |
| NCLIV_070010 | hypothetical protein, conserved |
| NCLIV_036300 | conserved hypothetical protein |
| NCLIV_057950 | unspecified product |
| NCLIV_038320 | unspecified product |
| NCLIV_040600 | hypothetical protein |
| NCLIV_030820 | conserved hypothetical protein |
| NCLIV_034990 | Transketolase, pyridine binding domain protein, related |
| NCLIV_037520 | conserved hypothetical protein |
| NCLIV_054120 | unspecified product |
| NCLIV_061210 | conserved hypothetical protein |
| NCLIV_010650 | conserved hypothetical protein |

TABLE C-continued

| Accession number[1] | Description[2] |
|---|---|
| NCLIV_026340 | hypothetical protein |
| NCLIV_013150 | conserved hypothetical protein |
| NCLIV_055360 | unspecified product |
| NCLIV_066600 | DEHA2F06798p, related |
| NCLIV_015790 | putative fatly acyl-CoA desaturase |
| NCLIV_055730 | hypothetical protein |
| NCLIV_067140 | Myosin, related |
| NCLIV_007800 | unspecified product |
| NCLIV_008850 | conserved hypothetical protein |
| NCLIV_028110 | putative DnaJ protein |
| NCLIV_065470 | hypothetical protein |
| NCLIV_040650 | conserved hypothetical protein |
| NCLIV_041830 | os07g0543600 protein, related |
| NCLIV_050590 | GL11864, related |
| NCLIV_051010 | putative signal peptide peptidase domain-containing protein |
| NCLIV_058800 | hypothetical protein |
| NCLIV_003190 | putative mitochondrial carrier domain-containing protein |
| NCLIV_042820 | cDNA FLJ58099, highly similar to *Homo sapiens* clathrin, heavy polypeptide-like 1 (CLTCL1), transcript variant 1, mRNA, related |
| NCLIV_058840 | conserved hypothetical protein |
| NCLIV_020980 | hypothetical protein |
| NCLIV_032050 | putative DnaJ domain-containing protein |
| NCLIV_053290 | ORF73, related |
| NCLIV_060220 | conserved hypothetical protein |
| NCLIV_061940 | hypothetical protein |
| NCLIV_003650 | hypothetical protein |
| NCLIV_006290 | conserved hypothetical protein |
| NCLIV_016800 | putative TCP-1/cpn60 chaperonin family protein |
| NCLIV_034130 | hypothetical protein |
| NCLIV_052350 | conserved hypothetical protein |
| NCLIV_054570 | 60S ribosomal protein L128B 27a, related |
| NCLIV_055850 | unspecified product |
| NCLIV_015480 | emp24/gp25L/p24 family domain-containing,transmembrane protein |
| NCLIV_015950 | conserved hypothetical protein |
| NCLIV_030620 | conserved hypothetical protein |
| NCLIV_041210 | putative Ubiquinol-cytochrome c reductase complex 14 kDa protein |
| NCLIV_047860 | hypothetical protein |
| NCLIV_054250 | Acyl-CoA synthetase, related |
| NCLIV_058890 | tubulin alpha chain |
| NCLIV_070060 | RNA binding protein, putative |
| NCLIV_003580 | conserved hypothetical protein |
| NCLIV_005620 | putative articulin 4 |
| NCLIV_036700 | putative M16 family peptidase |
| NCLIV_056570 | Collagen alpha-1(III) chain (Precursor), related |
| NCLIV_059730 | conserved hypothetical protein |
| NCLIV_008230 | delta-aminolevulinic acid dehydratase, related |
| NCLIV_015410 | hypothetical protein |
| NCLIV_032390 | conserved hypothetical protein |
| NCLIV_033780 | YALI0B05610p, related |
| NCLIV_036610 | hypothetical protein |
| NCLIV_045300 | Chloroquine resistance marker protein, related |
| NCLIV_049830 | conserved hypothetical protein |
| NCLIV_055760 | conserved hypothetical protein |
| NCLIV_058440 | Os02g0824100 protein, related |
| NCLIV_064840 | conserved hypothetical protein |
| NCLIV_038360 | tsp1 domain-containing protein TSP12 (Precursor),related |
| NCLIV_043760 | conserved hypothetical protein |
| NCLIV_052270 | conserved hypothetical protein |
| NCLIV_013180 | GM04207p, related |
| NCLIV_027850 | unspecified product |
| NCLIV_011960 | conserved hypothetical protein |
| NCLIV_018530 | conserved hypothetical protein |
| NCLIV_022690 | conserved hypothetical protein |
| NCLIV_024630 | putative porin |
| NCLIV_027530 | putative lectin-domain protein |
| NCLIV_045600 | putative glycosyl transferase, group 1 domain containing protein |
| NCLIV_001970 | unspecified product |
| NCLIV_011410 | protein disulfide isomerase |
| NCLIV_014360 | hypothetical protein |
| NCLIV_019110 | HSP90-like protein, related |
| NCLIV_030070 | conserved hypothetical protein |
| NCLIV_014430 | conserved hypothetical protein |
| NCLIV_042410 | putative sortilin |
| NCLIV_043930 | kelch repeat-containing proteins that is fused to a HSP90-like ATpase, related |
| NCLIV_061560 | conserved hypothetical protein |
| NCLIV_025670 | ATP synthase subunit beta, related |
| NCLIV_027930 | unspecified product |
| NCLIV_028540 | conserved hypothetical protein |

TABLE C-continued

| Accession number[1] | Description[2] |
|---|---|
| NCLIV_064260 | putative WD domain-containing protein |
| NCLIV_069590 | hypothetical protein |
| NCLIV_013360 | putative plectin |
| NCLIV_040540 | hypothetical protein |
| NCLIV_040970 | putative malate: quinone oxidoreductase |
| NCLIV_056670 | conserved hypothetical protein |
| NCLIV_067010 | Mitochondrial phosphate carrier protein, related |
| NCLIV_004140 | hypothetical protein |
| NCLIV_028750 | hypothetical protein |
| NCLIV_031780 | hypothetical protein |
| NCLIV_035190 | conserved hypothetical protein |
| NCLIV_050470 | hypothetical protein |
| NCLIV_051560 | Glucose transporter 1A, related |
| NCLIV_054800 | conserved hypothetical protein |
| NCLIV_064950 | hypothetical protein |
| NCLIV_011700 | unspecified product |
| NCLIV_012920 | unspecified product |
| NCLIV_024030 | conserved hypothetical protein |
| NCLIV_030890 | putative high molecular mass nuclear antigen |
| NCLIV_032780 | putative small heat shock protein 20 |
| NCLIV_060140 | putative inner membrane complex protein IMC3 |
| NCLIV_065210 | KLLA0F09449p, related |
| NCLIV_069460 | hypothetical protein |
| NCLIV_001660 | conserved hypothetical protein |
| NCLIV_016540 | conserved hypothetical protein |
| NCLIV_028680 | putative apical membrane antigen 1 |
| NCLIV_032830 | hypothetical protein |
| NCLIV_055490 | Heat shock protein 70 (Precursor), related |
| NCLIV_056560 | putative DEAD/DEAH box helicase |
| NCLIV_066840 | hypothetical protein |
| NCLIV_012100 | vacuolar protein sorting-associated protein,related |
| NCLIV_031770 | putative membrane skeletal protein IMC1 |
| NCLIV_047810 | hypothetical protein |
| NCLIV_060660 | SRS domain-containing protein |
| NCLIV_006490 | putative myosin light chain 2 |
| NCLIV_020840 | hypothetical protein |
| NCLIV_028090 | conserved hypothetical protein |
| NCLIV_040440 | conserved hypothetical protein |
| NCLIV_044200 | hypothetical protein |
| NCLIV_051110 | conserved hypothetical protein |
| NCLIV_053940 | 60S acidic ribosomal protein P2, related |
| NCLIV_055720 | hypothetical protein |
| NCLIV_068850 | unspecified product |
| NCLIV_019520 | MGC83258 protein, related |
| NCLIV_020720 | putative microneme protein MIC11 |
| NCLIV_022950 | putative RNA-binding protein |
| NCLIV_031670 | conserved hypothetical protein |
| NCLIV_032110 | conserved hypothetical protein |
| NCLIV_056300 | conserved hypothetical protein |
| NCLIV_063370 | conserved hypothetical protein |
| NCLIV_007770 | putative Rhoptry kinase family protein, truncated (incomplete catalytic triad) |
| NCLIV_036570 | YALI0D21604p, related |
| NCLIV_051840 | hypothetical protein |
| NCLIV_052390 | hypothetical protein |
| NCLIV_062890 | hypothetical protein |
| NCLIV_003050 | putative myosin heavy chain |
| NCLIV_004810 | conserved hypothetical protein |
| NCLIV_021080 | hypothetical protein |
| NCLIV_000940 | putative Glucose-6-phosphate dehydrogenase |
| NCLIV_010730 | srs domain-containing protein |
| NCLIV_014950 | putative trans-2,3-enoyl-CoA reductase |
| NCLIV_020920 | conserved hypothetical protein |
| NCLIV_037190 | putative glyceraldehyde-3-phosphate dehydrogenase |
| NCLIV_048380 | conserved hypothetical protein |
| NCLIV_049900 | hypothetical protein |
| NCLIV_056430 | conserved hypothetical protein |
| NCLIV_060730 | unspecified product |
| NCLIV_062940 | putative pyruvate dehydrogenase |
| NCLIV_064490 | putative phosphatidylinositol 3-and 4-kinase domain-containing protein |
| NCLIV_012230 | Ribose-phosphate pyrophosphokinase,related |
| NCLIV_015260 | conserved hypothetical protein |
| NCLIV_017840 | conserved hypothetical protein |
| NCLIV_023790 | conserved hypothetical protein |
| NCLIV_057710 | putative ATP synthase epsilon chain |
| NCLIV_061040 | hypothetical protein |
| NCLIV_025600 | putative calmodulin |
| NCLIV_0260 | armadillo/beta-catenin-like repeat-containing protein |
| NCLIV_033250 | SRS domain-containing protein |

TABLE C-continued

| Accession number[1] | Description[2] |
|---|---|
| NCLIV_048040 | conserved hypothetical protein |
| NCLIV_059960 | conserved hypothetical protein |
| NCLIV_066020 | hypothetical protein |
| NCLIV_070170 | hypothetical protein |
| NCLIV_012400 | Articulin family protein, related |
| NCLIV_036830 | conserved hypothetical protein |
| NCLIV_041120 | conserved hypothetical protein |
| NCLIV_053880 | cDNA FLJ54097, highly similar to Succinyl-CoA ligase (ADP-forming) beta-chain, mitochondrial, related |
| NCLIV_025920 | hypothetical protein |
| NCLIV_033680 | Solute carrier family 25 (Mitochondrial carrier,dicarboxylate transporter), member 10, related |
| NCLIV_043270 | putative microneme protein MIC1 |
| NCLIV_064530 | Histone H2A, related |
| NCLIV_015210 | putative ATP-dependent helicase, putative |
| NCLIV_019830 | hypothetical protein |
| NCLIV_025450 | putative elongation factor Tu |
| NCLIV_048050 | conserved hypothetical protein |
| NCLIV_049080 | hypothetical protein |
| NCLIV_058450 | putative myosin regulatory light chain |
| NCLIV_003310 | hypothetical protein |
| NCLIV_026600 | putative 46 kDa FK506-binding nuclear protein |
| NCLIV_040040 | grpe protein homolog, related |

[1]Accession number for the identified protein in ToxoDB database (ToxoDB-13.0_NcaninumLIV_AnnotatedProteins; 7122 sequences; Date Feb. 9, 2015) (Gajria et al., 2008, Nucleic Acids Res. 36; Database issue: D553-556).
[2]Protein description in ToxoDB database (ToxoDB-13.0_NcaninumLIV_AnnotatedProteins; 7122 sequences; Date Feb. 9, 2015) (Gajria et al., 2008, Nucleic Acids Res. 36; Database issue: D553-556).

The WTE with which the amount of protein of the composition of the present invention is compared is prepared as in Example 4 of the present specification (Example 4.1.1. (*Neospora caninum* cultures, tachyzoite production for EAE and WTE, and EAE and WTE production).

The extract preparation for LC-MS/MS experiments and the analyses are described in Example 4 of the present specification (Examples 4.1.2. (Sample preparation for LC-MS/MS experiments), 4.1.3. (Liquid Chromatography Tandem Mass Spectrometry (LC-MS/MS)), 4.1.4. (Peptide Identification by Mascot Database Searches), 4.1.5. (Protein relative quantification), 4.1.6. (In Silico analysis of diferentially abundant identified proteins) and 4.2.2 (Relative quantification between EAE and WTE)). The procedures, conditions, apparatuses and databases described in the above examples are preferably used in the context of the present invention.

The protein composition of the present invention comprises (or, alternatively, consists of) at least one such as 1, 2, 3, 4, 5, 6, 7, 8, 9, 10, 15, 20, 30, 40, 50, 60, 70, 75, 80, 90, 100, 125, 150, 175, 200, 225, 250, 261 of the proteins as listed in Table C above in an amount of at least about 1.5 times (fold change) higher than the same protein present in the WTE, as determined by relative quantification by quantitative label-free LC-MS/MS analysis. Preferably, the protein composition of the present invention comprises (or, alternatively, consists of) at least 5, more preferably at least 10, even more preferably at least 25, or at least 50, or at least 75, or at least 100, or at least 150, or at least 200, or at least 250 of the proteins as listed in Table C above in an amount of at least about 1.5 times (fold change) higher than the same protein present in the WTE, as determined by relative quantification by quantitative label-free LC-MS/MS analysis. Even more preferably, the protein composition of the present invention comprises (or, alternatively, consists of) all of the proteins as listed in Table C above in an amount of at least about 1.5 times (fold change) higher than the same protein present in the WTE, as determined by relative quantification by quantitative label-free LC-MS/MS analysis.

TABLE D

| Accession number[1] | Description[2] |
|---|---|
| NCLIV_070010 | hypothetical protein, conserved \| protein length = 2995 |
| NCLIV_019110 | HSP90-like protein, related \| protein length = 851 |
| NCLIV_042820 | cDNA FLJ58099, highly similar to *Homo sapiens* clathrin, heavy polypeptide-like 1 (CLTCL1), transcript variant 1, mRNA, related \| protein length = 1732 |
| NCLIV_048590 | unspecified product \| protein length = 1937 |
| NCLIV_049900 | hypothetical protein \| protein length = 831 |
| NCLIV_055360 | unspecified product \| protein length = 1640 |
| NCLIV_055490 | Heat shock protein 70 (Precursor), related \| protein length = 666 |
| NCLIV_064620 | unspecified product \| protein length = 1479 |
| NCLIV_033950 | Heat shock protein 70, related \| protein length = 671 |
| NCLIV_011410 | protein disulfide isomerase \| protein length = 471 |
| NCLIV_046170 | Heat Shock Protein 70, ER lumen, related \| protein length = 951 |
| NCLIV_040880 | hsp90, related \| protein length = 706 |
| NCLIV_059600 | putative KH domain-containing protein \| protein length = 950 |
| NCLIV_014060 | putative lysophospholipase \| protein length = 949 |
| NCLIV_001670 | elongation factor 1-alpha, related \| protein length = 448 |
| NCLIV_066840 | hypothetical protein \| protein length = 736 |
| NCLIV_066020 | hypothetical protein \| protein length = 316 |
| NCLIV_001970 | unspecified product \| protein length = 594 |

TABLE D-continued

| Accession number[1] | Description[2] |
|---|---|
| NCLIV_003050 | putative myosin heavy chain \| protein length = 1123 |
| NCLIV_046050 | hypothetical protein \| protein length = 1226 |
| NCLIV_020840 | hypothetical protein \| protein length = 568 |
| NCLIV_031550 | unspecified product \| protein length = 425 |
| NCLIV_019770 | hypothetical protein \| protein length = 520 |
| NCLIV_007260 | putative p97 protein \| protein length = 847 |
| NCLIV_015430 | hypothetical protein \| protein length = 1915 |
| NCLIV_067140 | Myosin, related \| protein length = 1941 |
| NCLIV_039100 | hypothetical protein \| protein length = 449 |
| NCLIV_002940 | putative microneme protein MIC4 \| protein length = 595 |
| NCLIV_045800 | 60S ribosomal protein L3, related \| protein length = 398 |
| NCLIV_047860 | hypothetical protein \| protein length = 763 |
| NCLIV_031780 | hypothetical protein \| protein length = 606 |
| NCLIV_046260 | Iron regulatory protein-like protein, related \| protein length = 986 |
| NCLIV_003440 | actin, related \| protein length = 376 |
| NCLIV_015440 | hypothetical protein \| protein length = 938 |
| NCLIV_032660 | hypothetical protein \| protein length = 259 |
| NCLIV_005150 | hypothetical protein \| protein length = 449 |
| NCLIV_058890 | tubulin alpha chain \| protein length = 453 |
| NCLIV_017370 | putative CAMP-dependent protein kinase regulatory subunit \| protein length = 385 |
| NCLIV_025670 | ATP synthase subunit beta, related \| protein length = 561 |
| NCLIV_007800 | unspecified product \| protein length = 1961 |
| NCLIV_034460 | hypothetical protein \| protein length = 592 |
| NCLIV_043270 | putative microneme protein MIC1 \| protein length = 460 |
| NCLIV_033230 | SRS domain-containing protein \| protein length = 319 |
| NCLIV_065210 | KLLA0F09449p, related \| protein length = 575 |
| NCLIV_010600 | putative microneme protein MIC3 \| protein length = 362 |
| NCLIV_060730 | unspecified product \| protein length = 549 |
| NCLIV_025240 | putative Gbp1p protein \| protein length = 294 |
| NCLIV_038360 | tsp1 domain-containing protein TSP12 (Precursor), related \| protein length = 1335 |
| NCLIV_016800 | putative TCP-1/cpn60 chaperonin family protein \| protein length = 576 |
| NCLIV_068400 | unspecified product \| protein length = 626 |
| NCLIV_068460 | unspecified product \| protein length = 993 |
| NCLIV_050370 | unspecified product \| protein length = 362 |
| NCLIV_053580 | 50S ribosomal protein L4P, related \| protein length = 416 |
| NCLIV_024820 | 14-3-3 protein homolog \| protein length = 266 |
| NCLIV_0230 | eukaryotic translation initiation factor 3 subunit 10 \| protein length = 1059 |
| NCLIV_001520 | eukaryotic translation initiation factor 3 subunit C, related \| protein length = 975 |
| NCLIV_039400 | hypothetical protein \| protein length = 704 |
| NCLIV_048570 | conserved hypothetical protein \| protein length = 251 |
| NCLIV_025920 | hypothetical protein \| protein length = 277 |
| NCLIV_001300 | putative calmodulin \| protein length = 133 |
| NCLIV_068920 | SRS domain-containing protein \| protein length = 387 |
| NCLIV_036700 | putative M16 family peptidase \| protein length = 1408 |
| NCLIV_002520 | hypothetical protein \| protein length = 263 |
| NCLIV_045585 | conserved hypothetical protein \| protein length = 513 |
| NCLIV_061170 | hypothetical protein \| protein length = 842 |
| NCLIV_025190 | LOC549444 protein, related \| protein length = 183 |
| NCLIV_011980 | calmodulin-like domain protein kinase isoenzyme gamma, related \| protein length = 506 |
| NCLIV_034130 | hypothetical protein \| protein length = 598 |
| NCLIV_012920 | unspecified product \| protein length = 391 |
| NCLIV_032430 | conserved hypothetical protein \| protein length = 474 |
| NCLIV_021050 | unspecified product \| protein length = 865 |
| NCLIV_058440 | Os02g0824100 protein, related \| protein length = 495 |
| NCLIV_030050 | unspecified product \| protein length = 890 |
| NCLIV_008850 | conserved hypothetical protein \| protein length = 1981 |
| NCLIV_000010 | putative heat shock protein 90 \| protein length = 818 |
| NCLIV_004190 | putative thioredoxin \| protein length = 428 |
| NCLIV_020220 | putative elongation factor 2 \| protein length = 832 |
| NCLIV_061160 | putative acid phosphatase \| protein length = 436 |
| NCLIV_017500 | hypothetical protein \| protein length = 192 |
| NCLIV_015380 | conserved hypothetical protein \| protein length = 338 |
| NCLIV_050590 | GL11864, related \| protein length = 503 |
| NCLIV_024740 | Myosin, heavy polypeptide 1, skeletal muscle, adult, related \| protein length = 766 |
| NCLIV_0341 | eukaryotic translation initiation factor 3 subunit 6 interacting protein \| protein length = 643 |
| NCLIV_031670 | conserved hypothetical protein \| protein length = 582 |
| NCLIV_030940 | hypothetical protein \| protein length = 1079 |
| NCLIV_065470 | hypothetical protein \| protein length = 458 |
| NCLIV_015920 | Histone H4, related \| protein length = 103 |
| NCLIV_010730 | srs domain-containing protein \| protein length = 387 |
| NCLIV_033690 | hypothetical protein \| protein length = 756 |
| NCLIV_068850 | unspecified product \| protein length = 557 |
| NCLIV_032390 | conserved hypothetical protein \| protein length = 225 |
| NCLIV_021080 | hypothetical protein \| protein length = 260 |
| NCLIV_015880 | hypothetical protein \| protein length = 196 |
| NCLIV_048460 | putative thioredoxin \| protein length = 623 |

TABLE D-continued

| Accession number[1] | Description[2] |
|---|---|
| NCLIV_010320 | putative dihydrolipoamide branched chain transacylase, E2 subunit | protein length = 656 |
| NCLIV_042410 | putative sortilin | protein length = 951 |
| NCLIV_015410 | hypothetical protein | protein length = 166 |
| NCLIV_037190 | putative glyceraldehyde-3-phosphate dehydrogenase | protein length = 1028 |
| NCLIV_060820 | V-type ATP synthase beta chain, related | protein length = 505 |
| NCLIV_000390 | conserved hypothetical protein | protein length = 412 |
| NCLIV_050470 | hypothetical protein | protein length = 530 |
| NCLIV_012120 | hypothetical protein | protein length = 261 |
| NCLIV_041740 | conserved hypothetical protein | protein length = 950 |
| NCLIV_016850 | AT3G15980 protein, related | protein length = 1239 |
| NCLIV_031970 | hypothetical protein | protein length = 2552 |
| NCLIV_041180 | 60s ribosomal protein L10, related | protein length = 221 |
| NCLIV_030420 | Rcn2-prov protein, related | protein length = 350 |
| NCLIV_010720 | srs domain-containing protein | protein length = 406 |
| NCLIV_036830 | conserved hypothetical protein | protein length = 909 |
| NCLIV_045460 | Mitochondrial presequence protease (Precursor), related | protein length = 1311 |
| NCLIV_024880 | 30S ribosomal protein S9P, related | protein length = 148 |
| NCLIV_062720 | hypothetical protein | protein length = 205 |
| NCLIV_025160 | hypothetical protein | protein length = 146 |
| NCLIV_054140 | putative adenylyl cyclase associated protein | protein length = 223 |
| NCLIV_052390 | hypothetical protein | protein length = 217 |
| NCLIV_067010 | Mitochondrial phosphate carrier protein, related | protein length = 334 |
| NCLIV_066310 | DEAD-box ATP-dependent RNA helicase 34, related | protein length = 411 |
| NCLIV_015210 | putative ATP-dependent helicase, putaive | protein length = 395 |
| NCLIV_022220 | hypothetical protein | protein length = 574 |
| NCLIV_061830 | 60S acidic ribosomal protein P0 | protein length = 311 |
| NCLIV_043330 | hypothetical protein | protein length = 203 |
| NCLIV_024630 | putative porin | protein length = 290 |
| NCLIV_032290 | SSU ribosomal protein S3P, related | protein length = 235 |
| NCLIV_056430 | conserved hypothetical protein | protein length = 438 |
| NCLIV_018530 | conserved hypothetical protein | protein length = 955 |
| NCLIV_065090 | conserved hypothetical protein | protein length = 695 |
| NCLIV_049050 | RNA helicase-related protein required for pre-mRNA splicing, related | protein length = 2230 |
| NCLIV_047660 | hypothetical protein | protein length = 477 |
| NCLIV_052350 | conserved hypothetical protein | protein length = 244 |
| NCLIV_064950 | hypothetical protein | protein length = 505 |
| NCLIV_029990 | putative vacuolar ATP synthase catalytic subunit A | protein length = 573 |
| NCLIV_050680 | hypothetical protein | protein length = 578 |
| NCLIV_038400 | methionine aminopeptidase, related | protein length = 404 |
| NCLIV_020250 | hypothetical protein | protein length = 556 |
| NCLIV_067180 | Glucose-6-phosphate 1-dehydrogenase, related | protein length = 728 |
| NCLIV_023090 | hypothetical protein | protein length = 376 |
| NCLIV_045010 | hypothetical protein | protein length = 205 |
| NCLIV_032270 | conserved hypothetical protein | protein length = 330 |
| NCLIV_047810 | hypothetical protein | protein length = 257 |
| NCLIV_024420 | hypothetical protein | protein length = 353 |
| NCLIV_044000 | hypothetical protein | protein length = 268 |
| NCLIV_003310 | hypothetical protein | protein length = 312 |
| NCLIV_062520 | 3-ketoacyl-(Acyl-carrier-protein) reductase, related | protein length = 376 |
| NCLIV_010740 | putative kelch motif domain-containing protein | protein length = 398 |
| NCLIV_069590 | hypothetical protein | protein length = 557 |
| NCLIV_044200 | hypothetical protein | protein length = 620 |
| NCLIV_031770 | putative membrane skeletal protein IMC1 | protein length = 436 |
| NCLIV_024870 | hypothetical protein | protein length = 212 |
| NCLIV_028680 | putative apical membrane antigen 1 | protein length = 569 |
| NCLIV_067350 | putative P-type Ca(2+)-ATPase | protein length = 1341 |
| NCLIV_055720 | hypothetical protein | protein length = 1794 |
| NCLIV_032330 | Malate dehydrogenase (NAD) (Precursor), related | protein length = 329 |
| NCLIV_018420 | unspecified product | protein length = 347 |
| NCLIV_037520 | conserved hypothetical protein | protein length = 536 |
| NCLIV_055760 | conserved hypothetical protein | protein length = 550 |
| NCLIV_036400 | unspecified product | protein length = 190 |
| NCLIV_007770 | putative Rhoptry kinase family protein, truncated (incomplete catalytic triad) | protein length = 378 |
| NCLIV_057950 | unspecified product | protein length = 945 |
| NCLIV_002590 | phthalate dioxygenase reductase subunit, related | protein length = 681 |
| NCLIV_055850 | unspecified product | protein length = 406 |
| NCLIV_046690 | VASA RNA helicase, related | protein length = 769 |
| NCLIV_065270 | hypothetical protein | protein length = 544 |
| NCLIV_020720 | putative microneme protein MIC11 | protein length = 203 |
| NCLIV_064700 | Ribosomal protein L18, related | protein length = 187 |
| NCLIV_011730 | unspecified product | protein length = 540 |
| NCLIV_005620 | putative articulin 4 | protein length = 466 |
| NCLIV_056480 | hypothetical protein | protein length = 540 |
| NCLIV_035250 | GK18150, related | protein length = 642 |
| NCLIV_057820 | hypothetical protein | protein length = 847 |

TABLE D-continued

| Accession number[1] | Description[2] |
|---|---|
| NCLIV_001070 | histone H2B, related | protein length = 116 |
| NCLIV_066630 | unspecified product | protein length = 318 |
| NCLIV_064360 | 50S ribosomal protein L24P, related | protein length = 141 |
| NCLIV_009450 | 60s ribosomal protein L17, related | protein length = 195 |
| NCLIV_010200 | hypothetical protein | protein length = 311 |
| NCLIV_000510 | putative translocation protein sec62 | protein length = 390 |
| NCLIV_030860 | conserved hypothetical protein | protein length = 564 |
| NCLIV_018120 | conserved hypothetical protein | protein length = 686 |
| NCLIV_039030 | hypothetical protein | protein length = 134 |
| NCLIV_029420 | putative myosin light chain TgMLC1 | protein length = 216 |
| NCLIV_036280 | 30S ribosomal protein S15P/S13e, related | protein length = 151 |
| NCLIV_032780 | putative small heat shock protein 20 | protein length = 228 |
| NCLIV_065010 | hypothetical protein | protein length = 210 |
| NCLIV_046040 | hypothetical protein | protein length = 161 |
| NCLIV_041930 | unspecified product | protein length = 201 |
| NCLIV_027160 | conserved hypothetical protein | protein length = 250 |
| NCLIV_064440 | hypothetical protein | protein length = 188 |
| NCLIV_049600 | 30S ribosomal protein S8P, related | protein length = 171 |
| NCLIV_046800 | putative AGC kinase | protein length = 343 |
| NCLIV_066600 | DEHA2F06798p, related | protein length = 454 |
| NCLIV_028170 | unspecified product | protein length = 581 |
| NCLIV_055710 | putative 60S ribosomal protein L23 | protein length = 139 |
| NCLIV_011700 | unspecified product | protein length = 316 |
| NCLIV_037500 | unspecified product | protein length = 475 |
| NCLIV_036610 | hypothetical protein | protein length = 473 |
| NCLIV_038850 | putative fumarase | protein length = 609 |
| NCLIV_065590 | putative NAD-specific glutamate dehydrogenase | protein length = 1122 |
| NCLIV_056700 | 26S proteasome regulatory subunit rpn1, related | protein length = 1084 |
| NCLIV_014360 | hypothetical protein | protein length = 1037 |
| NCLIV_043930 | kelch repeat-containing proteins that is fused to a HSP90-like ATpase, related | protein length = 1938 |
| NCLIV_013150 | conserved hypothetical protein | protein length = 330 |
| NCLIV_032110 | conserved hypothetical protein | protein length = 460 |
| NCLIV_015160 | hypothetical protein | protein length = 190 |
| NCLIV_024840 | hypothetical protein | protein length = 469 |
| NCLIV_032770 | hypothetical protein | protein length = 909 |
| NCLIV_018400 | putative TCP-1/cpn60 family chaperonin | protein length = 569 |
| NCLIV_033250 | SRS domain-containing protein | protein length = 401 |
| NCLIV_063860 | putative thioredoxin | protein length = 250 |
| NCLIV_060660 | SRS domain-containing protein | protein length = 357 |
| NCLIV_041780 | lsu ribosomal protein L19E, related | protein length = 186 |
| NCLIV_027600 | conserved hypothetical protein | protein length = 592 |
| NCLIV_060220 | conserved hypothetical protein | protein length = 2981 |
| NCLIV_004160 | histone H2B, related | protein length = 123 |
| NCLIV_062950 | 50S ribosomal protein L21e, related | protein length = 157 |
| NCLIV_031510 | hypothetical protein | protein length = 145 |
| NCLIV_056670 | conserved hypothetical protein | protein length = 274 |
| NCLIV_048020 | hypothetical protein | protein length = 328 |
| NCLIV_000740 | class I chitinase, related | protein length = 708 |
| NCLIV_051820 | hypothetical protein | protein length = 202 |
| NCLIV_042590 | 2-oxoglutarate dehydrogenase E1 component, related | protein length = 361 |
| NCLIV_054800 | conserved hypothetical protein | protein length = 623 |
| NCLIV_000940 | putative Glucose-6-phosphate dehydrogenase | protein length = 486 |
| NCLIV_059430 | hypothetical protein | protein length = 321 |
| NCLIV_018800 | hypothetical protein | protein length = 1125 |
| NCLIV_062460 | conserved hypothetical protein | protein length = 1998 |
| NCLIV_063970 | putative long chain acyl-CoA synthetase | protein length = 828 |
| NCLIV_004860 | hypothetical protein | protein length = 2559 |
| NCLIV_043760 | conserved hypothetical protein | protein length = 165 |
| NCLIV_030820 | conserved hypothetical protein | protein length = 142 |
| NCLIV_006720 | conserved hypothetical protein | protein length = 203 |
| NCLIV_016540 | conserved hypothetical protein | protein length = 444 |
| NCLIV_054120 | unspecified product | protein length = 1102 |
| NCLIV_042450 | putative opine dehydrogenase | protein length = 435 |
| NCLIV_031340 | putative Splicing factor 3B subunit 3 | protein length = 1233 |
| NCLIV_015620 | 60S ribosomal protein L36, related | protein length = 101 |
| NCLIV_066250 | unspecified product | protein length = 198 |
| NCLIV_042070 | hypothetical protein | protein length = 332 |
| NCLIV_011270 | hypothetical protein | protein length = 418 |
| NCLIV_022970 | unspecified product | protein length = 765 |
| NCLIV_005010 | conserved hypothetical protein | protein length = 560 |
| NCLIV_028750 | hypothetical protein | protein length = 1232 |
| NCLIV_030660 | putative TCP-1/cpn60 family chaperonin | protein length = 548 |
| NCLIV_034530 | putative TCP-1/cpn60 family chaperonin | protein length = 542 |
| NCLIV_025580 | eukaryotic translation initiation factor 3 subunit 11 | protein length = 271 |
| NCLIV_032050 | putative DnaJ domain-containing protein | protein length = 851 |
| NCLIV_055730 | hypothetical protein | protein length = 764 |
| NCLIV_056680 | hypothetical protein | protein length = 193 |

TABLE D-continued

| Accession number[1] | Description[2] |
| --- | --- |
| NCLIV_043110 | putative interferon gamma-inducible protein 30 | protein length = 386 |
| NCLIV_053290 | ORF73, related | protein length = 1540 |
| NCLIV_054570 | 60S ribosomal protein Ll28B 27a, related | protein length = 147 |
| NCLIV_026150 | Histone H3, related | protein length = 136 |
| NCLIV_028540 | conserved hypothetical protein | protein length = 275 |
| NCLIV_014020 | Peroxiredoxin-2E-1, related | protein length = 267 |
| NCLIV_060140 | putative inner membrane complex protein IMC3 | protein length = 535 |
| NCLIV_038320 | unspecified product | protein length = 1111 |
| NCLIV_034270 | putative coatomer gamma 2-subunit protein | protein length = 1032 |
| NCLIV_006070 | 30s ribosomal protein S10P, related | protein length = 118 |
| NCLIV_024250 | hypothetical protein | protein length = 158 |
| NCLIV_047630 | putative 40S ribosomal protein S18 | protein length = 156 |
| NCLIV_053840 | unspecified product | protein length = 355 |
| NCLIV_022950 | putative RNA-binding protein | protein length = 277 |
| NCLIV_027480 | hypothetical protein | protein length = 395 |
| NCLIV_033680 | Solute carrier family 25 (Mitochondrial carrier, dicarboxylate transporter), member 10, related | protein length = 336 |
| NCLIV_059450 | hypothetical protein | protein length = 434 |
| NCLIV_061040 | hypothetical protein | protein length = 476 |
| NCLIV_050210 | putative KH domain-containing protein | protein length = 616 |
| NCLIV_005900 | translation INITIATION FACTOR 3 SUBUNIT 9-like protein, related | protein length = 759 |
| NCLIV_065450 | hypothetical protein | protein length = 112 |
| NCLIV_027780 | conserved hypothetical protein | protein length = 153 |
| NCLIV_033270 | hypothetical protein | protein length = 385 |
| NCLIV_030930 | putative peroxiredoxin 3 | protein length = 289 |
| NCLIV_062940 | putative pyruvate dehydrogenase | protein length = 559 |
| NCLIV_064420 | putative ubiquitin | protein length = 215 |
| NCLIV_020180 | hypothetical protein | protein length = 490 |
| NCLIV_064880 | conserved hypothetical protein | protein length = 1222 |
| NCLIV_004790 | putative 18 kDa cyclophilin | protein length = 178 |
| NCLIV_030490 | 30S ribosomal protein S12, related | protein length = 143 |
| NCLIV_052190 | conserved hypothetical protein | protein length = 435 |
| NCLIV_004730 | hypothetical protein | protein length = 380 |
| NCLIV_042650 | gg11844, related | protein length = 460 |
| NCLIV_015010 | conserved hypothetical protein | protein length = 648 |
| NCLIV_030890 | putative high molecular mass nuclear antigen | protein length = 918 |
| NCLIV_034090 | putative kinesin heavy chain | protein length = 1823 |
| NCLIV_030620 | conserved hypothetical protein | protein length = 228 |
| NCLIV_070060 | RNA binding protein, putative | protein length = 387 |
| NCLIV_012830 | putative MORN repeat-containing protein | protein length = 457 |
| NCLIV_043300 | putative nucleolar phosphoprotein nucleolin | protein length = 710 |
| NCLIV_025450 | putative elongation factor Tu | protein length = 488 |
| NCLIV_060420 | hypothetical protein | protein length = 781 |
| NCLIV_006640 | hypothetical protein | protein length = 3982 |
| NCLIV_059340 | conserved hypothetical protein | protein length = 624 |
| NCLIV_009640 | putative choline kinase | protein length = 558 |
| NCLIV_054720 | hypothetical protein | protein length = 925 |
| NCLIV_040970 | putative malate: quinone oxidoreductase | protein length = 551 |
| NCLIV_045870 | unspecified product | protein length = 207 |
| NCLIV_062570 | Contig An13c0020, complete genome, related | protein length = 463 |
| NCLIV_040440 | conserved hypothetical protein | protein length = 880 |
| NCLIV_040540 | hypothetical protein | protein length = 434 |
| NCLIV_053880 | cDNA FLJ54097, highly similar to Succinyl-CoA ligase (ADP-forming) beta-chain, mitochondrial, related | protein length = 495 |
| NCLIV_041790 | conserved hypothetical protein | protein length = 915 |
| NCLIV_057700 | hypothetical protein | protein length = 248 |
| NCLIV_051340 | putative toxofilin | protein length = 291 |
| NCLIV_038780 | 60s ribosomal protein L32, related | protein length = 134 |
| NCLIV_028090 | conserved hypothetical protein | protein length = 165 |
| NCLIV_053950 | hypothetical protein | protein length = 175 |
| NCLIV_024030 | conserved hypothetical protein | protein length = 221 |
| NCLIV_026600 | putative 46 kDa FK506-binding nuclear protein | protein length = 314 |
| NCLIV_000300 | conserved hypothetical protein | protein length = 254 |
| NCLIV_041940 | glyceraldehyde 3-phosphate dehydrogenase, related | protein length = 340 |
| NCLIV_026820 | conserved hypothetical protein | protein length = 158 |
| NCLIV_004400 | hypothetical protein | protein length = 475 |
| NCLIV_041120 | conserved hypothetical protein | protein length = 388 |
| NCLIV_016110 | hypothetical protein | protein length = 377 |
| NCLIV_020770 | hypothetical protein | protein length = 521 |
| NCLIV_004710 | hypothetical protein | protein length = 685 |
| NCLIV_004280 | hypothetical protein | protein length = 762 |
| NCLIV_001570 | eukaryotic translation initiation factor 3 subunit G-2, related | protein length = 1870 |
| NCLIV_001450 | hypothetical protein | protein length = 4864 |
| NCLIV_008730 | hypothetical protein | protein length = 165 |
| NCLIV_045650 | unspecified product | protein length = 211 |
| NCLIV_063980 | conserved hypothetical protein | protein length = 167 |
| NCLIV_033780 | YALI0B05610p, related | protein length = 199 |

TABLE D-continued

| Accession number[1] | Description[2] |
|---|---|
| NCLIV_054520 | hypothetical protein | protein length = 363 |
| NCLIV_015180 | ATP synthase, related | protein length = 252 |
| NCLIV_060400 | hypothetical protein | protein length = 169 |
| NCLIV_041100 | novel protein (Zgc: 66430), related | protein length = 279 |
| NCLIV_006490 | putative myosin light chain 2 | protein length = 368 |
| NCLIV_023620 | SRS domain-containing protein | protein length = 325 |
| NCLIV_028050 | conserved hypothetical protein | protein length = 281 |
| NCLIV_006180 | putative duplicated carbonic anhydrase | protein length = 522 |
| NCLIV_070280 | hypothetical protein | protein length = 472 |
| NCLIV_012130 | eukaryotic translation initiation factor 3 subunit 7-like protein, related | protein length = 529 |
| NCLIV_023790 | conserved hypothetical protein | protein length = 339 |
| NCLIV_018550 | YGR231Cp-like protein, related | protein length = 271 |
| NCLIV_008230 | delta-aminolevulinic acid dehydratase, related | protein length = 669 |
| NCLIV_022540 | conserved hypothetical protein | protein length = 580 |
| NCLIV_060380 | hypothetical protein | protein length = 415 |
| NCLIV_027530 | putative lectin-domain protein | protein length = 683 |
| NCLIV_032920 | hypothetical protein | protein length = 560 |
| NCLIV_068890 | unspecified product | protein length = 553 |
| NCLIV_062280 | conserved hypothetical protein | protein length = 341 |
| NCLIV_011210 | transketolase, related | protein length = 986 |
| NCLIV_061990 | conserved hypothetical protein | protein length = 1344 |
| NCLIV_001250 | putative guanylate binding protein | protein length = 1361 |
| NCLIV_020360 | 40S ribosomal protein S12, related | protein length = 142 |
| NCLIV_018890 | L24, related | protein length = 154 |
| NCLIV_036410 | putative cyst matrix protein | protein length = 456 |
| NCLIV_058550 | conserved hypothetical protein | protein length = 157 |
| NCLIV_045220 | hypothetical protein | protein length = 398 |
| NCLIV_000130 | hypothetical protein | protein length = 494 |
| NCLIV_060700 | SRS domain-containing protein | protein length = 351 |
| NCLIV_044410 | unspecified product | protein length = 592 |
| NCLIV_038750 | putative DNAJ domain-containing protein | protein length = 420 |
| NCLIV_028060 | conserved hypothetical protein | protein length = 547 |
| NCLIV_030900 | hypothetical protein | protein length = 1236 |
| NCLIV_041240 | nadh dehydrogenase, related | protein length = 646 |
| NCLIV_014150 | unspecified product | protein length = 130 |
| NCLIV_028240 | putative Ras family domain-containing protein | protein length = 217 |
| NCLIV_046550 | Elongation factor 1-beta, related | protein length = 242 |
| NCLIV_062730 | hypothetical protein | protein length = 331 |
| NCLIV_064310 | GTP-binding nuclear protein Ran, related | protein length = 216 |
| NCLIV_043400 | proteasome subunit p58, related | protein length = 554 |
| NCLIV_052240 | putative saccharopine dehydrogenase | protein length = 450 |
| NCLIV_054200 | Zgc: 92083, related | protein length = 846 |
| NCLIV_021720 | conserved hypothetical protein | protein length = 729 |
| NCLIV_018500 | Fatty acyl-CoA synthetase 2, related | protein length = 817 |
| NCLIV_049030 | hypothetical protein | protein length = 225 |
| NCLIV_029080 | hypothetical protein | protein length = 223 |
| NCLIV_041830 | os07g0543600 protein, related | protein length = 460 |
| NCLIV_006510 | putative TCP-1/cpn60 family chaperonin | protein length = 546 |
| NCLIV_051450 | putative centromere/microtubule binding protein | protein length = 503 |
| NCLIV_054250 | Acyl-CoA synthetase, related | protein length = 766 |
| NCLIV_049100 | Ribosomal protein S19e, related | protein length = 160 |
| NCLIV_057960 | unspecified product | protein length = 1044 |
| NCLIV_002780 | yml024wp-like protein, related | protein length = 132 |
| NCLIV_052230 | Succinate dehydrogenase iron-sulfur subunit, related | protein length = 339 |
| NCLIV_056360 | Eukaryotic initiation factor, related | protein length = 487 |
| NCLIV_056300 | conserved hypothetical protein | protein length = 490 |
| NCLIV_066870 | hypothetical protein | protein length = 161 |
| NCLIV_048030 | hypothetical protein | protein length = 120 |
| NCLIV_006060 | conserved hypothetical protein | protein length = 239 |
| NCLIV_015480 | emp24/gp25L/p24 family domain-containing, transmembrane protein | protein length = 255 |
| NCLIV_032910 | hypothetical protein | protein length = 377 |
| NCLIV_039090 | conserved hypothetical protein | protein length = 306 |
| NCLIV_051560 | Glucose transporter 1A, related | protein length = 487 |
| NCLIV_007450 | unspecified product | protein length = 552 |
| NCLIV_012400 | Articulin family protein, related | protein length = 462 |
| NCLIV_063340 | hypothetical protein | protein length = 651 |
| NCLIV_020990 | hypothetical protein | protein length = 1067 |
| NCLIV_051010 | putative signal peptide peptidase domain-containing protein | protein length = 467 |
| NCLIV_019000 | putative adenosine transporter | protein length = 465 |
| NCLIV_060760 | putative prolyl-tRNA synthetase | protein length = 656 |
| NCLIV_000840 | thioredoxin h, related | protein length = 106 |
| NCLIV_060860 | Cytochrome c, related | protein length = 115 |
| NCLIV_064530 | Histone H2A, related | protein length = 155 |
| NCLIV_027290 | Ribosomal protein S21-maize (ISS), related | protein length = 82 |
| NCLIV_007110 | hypothetical protein | protein length = 151 |
| NCLIV_006780 | conserved hypothetical protein | protein length = 196 |

TABLE D-continued

| Accession number[1] | Description[2] |
|---|---|
| NCLIV_064840 | conserved hypothetical protein \| protein length = 283 |
| NCLIV_019970 | Peptidyl-prolyl cis-trans isomerase A, related \| protein length = 172 |
| NCLIV_011550 | novel protein (Zgc: 77155), related \| protein length = 206 |
| NCLIV_012195 | unspecified product \| protein length = 161 |
| NCLIV_0260 | armadillo/beta-catenin-like repeat-containing protein \| protein length = 274 |
| NCLIV_051840 | hypothetical protein \| protein length = 289 |
| NCLIV_043880 | hypothetical protein \| protein length = 238 |
| NCLIV_055690 | hypothetical protein \| protein length = 214 |
| NCLIV_054750 | hypothetical protein \| protein length = 306 |
| NCLIV_065970 | conserved hypothetical protein \| protein length = 386 |
| NCLIV_030170 | hypothetical protein \| protein length = 129 |
| NCLIV_004380 | cathepsin L, related \| protein length = 415 |
| NCLIV_035910 | hypothetical protein \| protein length = 778 |
| NCLIV_039080 | adaptin N terminal region family protein, related \| protein length = 1117 |
| NCLIV_042390 | conserved hypothetical protein \| protein length = 237 |
| NCLIV_033850 | hypothetical protein \| protein length = 1613 |
| NCLIV_064540 | Ribosomal protein L37a, related \| protein length = 96 |
| NCLIV_000860 | spatr, related \| protein length = 545 |
| NCLIV_004750 | putative peptidase family M48 domain-containing protein \| protein length = 429 |
| NCLIV_047520 | conserved hypothetical protein \| protein length = 372 |
| NCLIV_066900 | putative serine/threonine protein phosphatase 5 \| protein length = 1035 |
| NCLIV_062630 | Thioredoxin-dependent peroxide reductase, mitochondrial, related \| protein length = 200 |
| NCLIV_051490 | conserved hypothetical protein \| protein length = 80 |
| NCLIV_029730 | putative Ras family domain-containing protein \| protein length = 214 |
| NCLIV_050300 | GH18750, related \| protein length = 465 |
| NCLIV_038000 | CUG-BP-and ETR-3-like factor 3, related \| protein length = 678 |
| NCLIV_056550 | Translation initiation factor 2 subunit alpha (AeIF-2a), related \| protein length = 352 |
| NCLIV_063370 | conserved hypothetical protein \| protein length = 388 |
| NCLIV_045260 | hypothetical protein \| protein length = 585 |
| NCLIV_003190 | putative mitochondrial carrier domain-containing protein \| protein length = 476 |
| NCLIV_053330 | conserved hypothetical protein \| protein length = 660 |
| NCLIV_004300 | putative dynamin-like protein \| protein length = 870 |
| NCLIV_067050 | conserved hypothetical protein \| protein length = 543 |
| NCLIV_002390 | nucleoside diphosphate kinase, related \| protein length = 155 |
| NCLIV_020650 | putative splicing factor 3B subunit 1 \| protein length = 1392 |
| NCLIV_055160 | conserved hypothetical protein \| protein length = 4555 |
| NCLIV_018290 | Ribosomal protein S26E, related \| protein length = 113 |
| NCLIV_016380 | Ribosomal protein L22, related \| protein length = 181 |
| NCLIV_003650 | hypothetical protein \| protein length = 336 |
| NCLIV_004920 | hypothetical protein \| protein length = 248 |
| NCLIV_058840 | conserved hypothetical protein \| protein length = 242 |
| NCLIV_052500 | hypothetical protein \| protein length = 299 |
| NCLIV_002770 | putative MORN repeat-containing protein \| protein length = 385 |
| NCLIV_069630 | hypothetical protein, conserved \| protein length = 239 |
| NCLIV_034990 | Transketolase, pyridine binding domain protein, related \| protein length = 483 |
| NCLIV_066100 | putative microtubule-binding protein \| protein length = 835 |
| NCLIV_018020 | hypothetical protein \| protein length = 1499 |
| NCLIV_013260 | conserved hypothetical protein \| protein length = 190 |
| NCLIV_012510 | hypothetical protein \| protein length = 118 |
| NCLIV_013320 | hypothetical protein \| protein length = 150 |
| NCLIV_052380 | hypothetical protein \| protein length = 135 |
| NCLIV_062890 | hypothetical protein \| protein length = 154 |
| NCLIV_031040 | Peptidyl-prolyl cis-trans isomerase, related \| protein length = 172 |
| NCLIV_045670 | hypothetical protein \| protein length = 134 |
| NCLIV_034470 | hypothetical protein \| protein length = 188 |
| NCLIV_066970 | putative enoyl-acyl carrier reductase \| protein length = 400 |
| NCLIV_046530 | putative reticulon domain-containing protein \| protein length = 197 |
| NCLIV_061940 | hypothetical protein \| protein length = 482 |
| NCLIV_069550 | unspecified product \| protein length = 463 |
| NCLIV_026430 | DnaJ domain containing protein, related \| protein length = 614 |
| NCLIV_049570 | hypothetical protein \| protein length = 584 |
| NCLIV_019450 | hypothetical protein \| protein length = 223 |
| NCLIV_025010 | hypothetical protein \| protein length = 337 |
| NCLIV_016970 | conserved hypothetical protein \| protein length = 579 |
| NCLIV_031460 | conserved hypothetical protein \| protein length = 510 |
| NCLIV_044290 | pyruvate dehydrogenase E2 component, related \| protein length = 920 |
| NCLIV_042660 | probable cytosol aminopeptidase, related \| protein length = 564 |
| NCLIV_064580 | hypothetical protein \| protein length = 392 |
| NCLIV_014950 | putative trans-2,3-enoyl-CoA reductase \| protein length = 298 |
| NCLIV_005420 | phosphoglycerate kinase, related \| protein length = 556 |
| NCLIV_006570 | putative serine/threonine protein phosphatase \| protein length = 692 |
| NCLIV_054110 | YHL017Wp-like protein, related \| protein length = 733 |
| NCLIV_009390 | putative Cleft lip and palate transmembrane protein 1 \| protein length = 626 |
| NCLIV_051800 | conserved hypothetical protein \| protein length = 1102 |
| NCLIV_032220 | 50S ribosomal protein L30e, related \| protein length = 108 |
| NCLIV_052510 | hypothetical protein \| protein length = 111 |
| NCLIV_016120 | putative proteasome subunit alpha type 4, subunit \| protein length = 252 |

TABLE D-continued

| Accession number[1] | Description[2] |
|---|---|
| NCLIV_038680 | hypothetical protein \| protein length = 230 |
| NCLIV_047080 | conserved hypothetical protein \| protein length = 128 |
| NCLIV_032560 | hypothetical protein \| protein length = 680 |
| NCLIV_038540 | rab22a, member RAS oncogene family, related \| protein length = 241 |
| NCLIV_042050 | hypothetical protein \| protein length = 232 |
| NCLIV_063740 | conserved hypothetical protein \| protein length = 450 |
| NCLIV_032620 | Cs1 protein, related \| protein length = 438 |
| NCLIV_060500 | conserved hypothetical protein \| protein length = 550 |
| NCLIV_029570 | conserved hypothetical protein \| protein length = 501 |
| NCLIV_007390 | mgc78841 protein, related \| protein length = 554 |
| NCLIV_014430 | conserved hypothetical protein \| protein length = 738 |
| NCLIV_000430 | conserved hypothetical protein \| protein length = 393 |
| NCLIV_069130 | hypothetical protein, conserved \| protein length = 813 |
| NCLIV_015200 | Pyruvate kinase, related \| protein length = 531 |
| NCLIV_044350 | conserved hypothetical protein \| protein length = 432 |
| NCLIV_024860 | Proteasome/cyclosome repeat family protein, related \| protein length = 1181 |
| NCLIV_001370 | putative DEAD/DEAH box helicase \| protein length = 2249 |
| NCLIV_015790 | putative fatty acyl-CoA desaturase \| protein length = 1386 |
| NCLIV_040610 | virulent strain associated lipoprotein, related \| protein length = 2597 |
| NCLIV_000710 | conserved hypothetical protein \| protein length = 221 |
| NCLIV_045240 | putative eukaryotic translation initiation factor 3 subunit 5 \| protein length = 346 |
| NCLIV_061210 | conserved hypothetical protein \| protein length = 393 |
| NCLIV_069600 | hypothetical protein, conserved \| protein length = 268 |
| NCLIV_048880 | Proteasome subunit beta type-7, related \| protein length = 242 |
| NCLIV_048040 | conserved hypothetical protein \| protein length = 492 |
| NCLIV_029860 | hypothetical protein \| protein length = 194 |
| NCLIV_019830 | hypothetical protein \| protein length = 262 |
| NCLIV_009780 | beta-lactamase domain protein (Precursor), related \| protein length = 1133 |
| NCLIV_022140 | GA11385, related \| protein length = 564 |
| NCLIV_018710 | hypothetical protein \| protein length = 454 |
| NCLIV_016370 | Galactosyltransferase, related \| protein length = 1298 |
| NCLIV_041650 | methionine--tRNAligase, related \| protein length = 982 |
| NCLIV_050390 | Pyrroline-5-carboxylate reductase, related \| protein length = 275 |
| NCLIV_039000 | probable 26S protease regulatory subunit 6B, related \| protein length = 443 |
| NCLIV_068380 | hypothetical protein \| protein length = 489 |
| NCLIV_047390 | conserved hypothetical protein \| protein length = 502 |
| NCLIV_025000 | hypothetical protein \| protein length = 1045 |
| NCLIV_037760 | Rhomboid-6, isoform A, related \| protein length = 646 |
| NCLIV_051890 | unspecified product \| protein length = 2001 |
| NCLIV_002380 | conserved hypothetical protein \| protein length = 277 |
| NCLIV_020340 | unspecified product \| protein length = 2592 |
| NCLIV_012230 | Ribose-phosphate pyrophosphokinase, related \| protein length = 555 |
| NCLIV_068970 | Succinate dehydrogenase flavoprotein subunit, related \| protein length = 420 |
| NCLIV_012890 | hypothetical protein \| protein length = 7289 |
| NCLIV_024830 | conserved hypothetical protein \| protein length = 139 |
| NCLIV_011320 | vesicle-associated membrane protein-associated protein A, related \| protein length = 239 |
| NCLIV_062310 | Function: human SRp75 can complement a splicing-deficient extract, related \| protein length = 353 |
| NCLIV_018510 | Hydrolase Cof, related \| protein length = 319 |
| NCLIV_060800 | Ubiquitin, related \| protein length = 535 |
| NCLIV_044230 | putative peptidase M16 domain containing protein \| protein length = 2231 |
| NCLIV_010010 | het-R, related \| protein length = 515 |
| NCLIV_062770 | unspecified product \| protein length = 682 |
| NCLIV_039500 | hypothetical protein \| protein length = 4520 |
| NCLIV_004140 | hypothetical protein \| protein length = 151 |
| NCLIV_025910 | Histone H2A, related \| protein length = 135 |
| NCLIV_021640 | unspecified product \| protein length = 217 |
| NCLIV_011820 | agap011504-PA, related \| protein length = 99 |
| NCLIV_006030 | putative dynein light chain \| protein length = 89 |
| NCLIV_061560 | conserved hypothetical protein \| protein length = 147 |
| NCLIV_000610 | putative profilin family protein \| protein length = 163 |
| NCLIV_053870 | hypothetical protein \| protein length = 132 |
| NCLIV_041210 | putative Ubiquinol-cytochrome c reductase complex 14 kDa protein \| protein length = 236 |
| NCLIV_024070 | conserved hypothetical protein \| protein length = 134 |
| NCLIV_061440 | hypothetical protein \| protein length = 210 |
| NCLIV_003580 | conserved hypothetical protein \| protein length = 290 |
| NCLIV_046830 | putative ATP synthase \| protein length = 202 |
| NCLIV_047040 | conserved hypothetical protein \| protein length = 189 |
| NCLIV_063330 | Ubiquinol-cytochrome c reductase cytochrome c1 subunit, related \| protein length = 343 |
| NCLIV_022420 | hypothetical protein \| protein length = 305 |
| NCLIV_063150 | Serpin peptidase inhibitor, clade B (Ovalbumin), member 1, like 3, related \| protein length = 413 |
| NCLIV_010020 | ubiquinol-cytochrome c reductase iron-sulfur subunit, related \| protein length = 382 |
| NCLIV_053810 | Os03g0795800 protein, related \| protein length = 265 |
| NCLIV_027850 | unspecified product \| protein length = 488 |

TABLE D-continued

| Accession number[1] | Description[2] |
|---|---|
| NCLIV_042510 | conserved hypothetical protein | protein length = 322 |
| NCLIV_044440 | hypothetical protein | protein length = 430 |
| NCLIV_014040 | conserved hypothetical protein | protein length = 400 |
| NCLIV_004060 | conserved hypothetical protein | protein length = 337 |
| NCLIV_015990 | hypothetical protein | protein length = 97 |
| NCLIV_040600 | hypothetical protein | protein length = 344 |
| NCLIV_018830 | conserved hypothetical protein | protein length = 789 |
| NCLIV_039750 | hypothetical protein | protein length = 502 |
| NCLIV_058180 | unspecified product | protein length = 491 |
| NCLIV_049830 | conserved hypothetical protein | protein length = 583 |
| NCLIV_031860 | putative serine-threonine phosphatase 2C | protein length = 321 |
| NCLIV_045440 | putative proteasome PCI domain-containing protein | protein length = 473 |
| NCLIV_025730 | conserved hypothetical protein | protein length = 770 |
| NCLIV_061030 | hypothetical protein | protein length = 444 |
| NCLIV_063190 | conserved hypothetical protein | protein length = 486 |
| NCLIV_017340 | hypothetical protein | protein length = 1369 |
| NCLIV_027930 | unspecified product | protein length = 615 |
| NCLIV_026180 | hypothetical protein | protein length = 487 |
| NCLIV_019930 | conserved hypothetical protein | protein length = 1312 |
| NCLIV_053940 | 60S acidic ribosomal protein P2, related | protein length = 111 |
| NCLIV_029690 | conserved hypothetical protein | protein length = 177 |
| NCLIV_005040 | conserved hypothetical protein | protein length = 160 |
| NCLIV_036130 | CBR-RSP-4 protein, related | protein length = 192 |
| NCLIV_026390 | putative centrin | protein length = 195 |
| NCLIV_008410 | gamma-aminobutyric acid receptor-associated protein-like 1, related | protein length = 124 |
| NCLIV_056910 | conserved hypothetical protein | protein length = 201 |
| NCLIV_068520 | unspecified product | protein length = 180 |
| NCLIV_065750 | Alpha 2 subunit of 20S proteasome (ISS), related | protein length = 258 |
| NCLIV_059980 | conserved hypothetical protein | protein length = 146 |
| NCLIV_066350 | Os06g0732000 protein, related | protein length = 123 |
| NCLIV_035190 | conserved hypothetical protein | protein length = 324 |
| NCLIV_058260 | hypothetical protein | protein length = 85 |
| NCLIV_001660 | conserved hypothetical protein | protein length = 334 |
| NCLIV_028110 | putative DnaJ protein | protein length = 253 |
| NCLIV_026540 | conserved hypothetical protein | protein length = 265 |
| NCLIV_025220 | conserved hypothetical protein | protein length = 204 |
| NCLIV_009030 | metallophosphoesterase, related | protein length = 340 |
| NCLIV_066080 | conserved hypothetical protein | protein length = 229 |
| NCLIV_020140 | hypothetical protein | protein length = 191 |
| NCLIV_026270 | 26S proteasome regulatory subunit S4 like AAA ATpase, related | protein length = 375 |
| NCLIV_007900 | pv1h14125_P, related | protein length = 396 |
| NCLIV_011140 | gl18351, related | protein length = 536 |
| NCLIV_050620 | putative lysine decarboxylase domain-containing protein | protein length = 395 |
| NCLIV_026210 | hypothetical protein | protein length = 351 |
| NCLIV_042680 | conserved hypothetical protein | protein length = 334 |
| NCLIV_040550 | conserved hypothetical protein | protein length = 217 |
| NCLIV_038410 | predicted hydrolases or acyltransferases, related | protein length = 320 |
| NCLIV_050910 | conserved hypothetical protein | protein length = 646 |
| NCLIV_017990 | conserved hypothetical protein | protein length = 1277 |
| NCLIV_003160 | nicotinate phosphoribosyltransferase, related | protein length = 591 |
| NCLIV_031500 | hypothetical protein | protein length = 765 |
| NCLIV_040860 | tryptophanyl-tRNAsynthetase, related | protein length = 607 |
| NCLIV_044840 | conserved hypothetical protein | protein length = 480 |
| NCLIV_036570 | YALI0D21604p, related | protein length = 945 |
| NCLIV_056950 | hypothetical protein | protein length = 1007 |
| NCLIV_062880 | conserved hypothetical protein | protein length = 805 |
| NCLIV_011400 | putative ATP-dependent helicase | protein length = 1394 |
| NCLIV_037460 | hypothetical protein | protein length = 578 |
| NCLIV_015260 | conserved hypothetical protein | protein length = 784 |
| NCLIV_013460 | hypothetical protein | protein length = 424 |
| NCLIV_049130 | putative XPG N-terminal domain containing protein | protein length = 753 |
| NCLIV_062350 | Ribosomal protein S27, related | protein length = 82 |
| NCLIV_028310 | conserved hypothetical protein | protein length = 143 |
| NCLIV_051110 | conserved hypothetical protein | protein length = 260 |
| NCLIV_028230 | Proteasome subunit alpha type-7, related | protein length = 246 |
| NCLIV_039960 | hypothetical protein | protein length = 310 |
| NCLIV_053890 | conserved hypothetical protein | protein length = 307 |
| NCLIV_036250 | Asparaginyl-tRNA synthetase, related | protein length = 542 |
| NCLIV_010970 | hypothetical protein | protein length = 318 |
| NCLIV_029040 | putative nucleosome assembly protein | protein length = 859 |
| NCLIV_045600 | putative glycosyl transferase, group 1 domain containing protein | protein length = 449 |
| NCLIV_024090 | putative glutamyl-tRNA synthetase | protein length = 775 |
| NCLIV_038570 | conserved hypothetical protein | protein length = 492 |
| NCLIV_032940 | putative adenosine transporter | protein length = 541 |
| NCLIV_003560 | putative mitochondrial alternative NADH dehydrogenase 1 | protein length = 619 |

TABLE D-continued

| Accession number[1] | Description[2] |
|---|---|
| NCLIV_004270 | putative protein kinase | protein length = 1118 |
| NCLIV_007330 | similar to uniprot|P15705 *Saccharomyces cerevisiae* YOR027w STI1, related | protein length = 563 |
| NCLIV_047530 | conserved hypothetical protein | protein length = 628 |
| NCLIV_043180 | hypothetical protein | protein length = 795 |
| NCLIV_043670 | high mobility group protein, related | protein length = 94 |
| NCLIV_024230 | Zgc: 123215, related | protein length = 98 |
| NCLIV_054540 | RAB5C, member RAS oncogene family, related | protein length = 185 |
| NCLIV_013360 | putative plectin | protein length = 2378 |
| NCLIV_022270 | unspecified product | protein length = 691 |
| NCLIV_020920 | conserved hypothetical protein | protein length = 2250 |
| NCLIV_044600 | conserved hypothetical protein | protein length = 104 |
| NCLIV_024410 | 10 kDa chaperonin, related | protein length = 105 |
| NCLIV_051970 | putative MIC2-associated protein M2AP | protein length = 243 |
| NCLIV_014760 | conserved hypothetical protein | protein length = 169 |
| NCLIV_029060 | conserved hypothetical protein | protein length = 256 |
| NCLIV_058450 | putative myosin regulatory light chain | protein length = 208 |
| NCLIV_054190 | hypothetical protein | protein length = 224 |
| NCLIV_017840 | conserved hypothetical protein | protein length = 119 |
| NCLIV_045430 | putative DNA-binding protein HU | protein length = 221 |
| NCLIV_046030 | hypothetical protein | protein length = 225 |
| NCLIV_056110 | putative small heat shock protein 21 | protein length = 194 |
| NCLIV_065830 | MGC79800 protein, related | protein length = 288 |
| NCLIV_003220 | putative vacuolar ATP synthase subunit h | protein length = 481 |
| NCLIV_044120 | conserved hypothetical protein | protein length = 192 |
| NCLIV_064810 | hypothetical protein | protein length = 725 |
| NCLIV_015530 | conserved hypothetical protein | protein length = 366 |
| NCLIV_048050 | conserved hypothetical protein | protein length = 324 |
| NCLIV_020430 | hypothetical protein | protein length = 821 |
| NCLIV_067220 | conserved hypothetical protein | protein length = 407 |
| NCLIV_030070 | conserved hypothetical protein | protein length = 225 |
| NCLIV_064600 | putative cysteine desulfurase | protein length = 811 |
| NCLIV_019750 | conserved hypothetical protein | protein length = 1207 |
| NCLIV_050030 | hypothetical protein | protein length = 475 |
| NCLIV_057710 | putative ATP synthase epsilon chain | protein length = 74 |
| NCLIV_024320 | conserved hypothetical protein | protein length = 75 |
| NCLIV_062710 | conserved hypothetical protein | protein length = 134 |
| NCLIV_009670 | cold-shock protein, DNA-binding, related | protein length = 125 |
| NCLIV_021100 | unspecified product | protein length = 237 |
| NCLIV_052880 | unspecified product | protein length = 193 |
| NCLIV_039480 | hypothetical protein | protein length = 94 |
| NCLIV_003680 | 40s ribosomal protein S28, related | protein length = 68 |
| NCLIV_051460 | conserved hypothetical protein | protein length = 112 |
| NCLIV_008890 | putative tim10/DDP zinc finger domain-containing protein | protein length = 91 |
| NCLIV_066190 | putative caltractin | protein length = 170 |
| NCLIV_011960 | conserved hypothetical protein | protein length = 263 |
| NCLIV_055330 | Fibrillarin superfamily, related | protein length = 263 |
| NCLIV_026340 | hypothetical protein | protein length = 177 |
| NCLIV_044100 | conserved hypothetical protein | protein length = 232 |
| NCLIV_018950 | putative coatomer epsilon subunit | protein length = 276 |
| NCLIV_022560 | Thermosome subunit, related | protein length = 539 |
| NCLIV_044950 | conserved hypothetical protein | protein length = 222 |
| NCLIV_027660 | conserved hypothetical protein | protein length = 130 |
| NCLIV_068630 | conserved hypothetical protein | protein length = 195 |
| NCLIV_055370 | conserved hypothetical protein | protein length = 391 |
| NCLIV_046840 | Acyl-carrier-protein S-malonyltransferase, related | protein length = 309 |
| NCLIV_056250 | hypothetical protein | protein length = 499 |
| NCLIV_048600 | hypothetical protein | protein length = 307 |
| NCLIV_032030 | conserved hypothetical protein | protein length = 164 |
| NCLIV_070190 | Dihydrolipoyl dehydrogenase (EC 1.8.1.4), related | protein length = 648 |
| NCLIV_017240 | conserved hypothetical protein | protein length = 293 |
| NCLIV_010610 | hypothetical protein | protein length = 300 |
| NCLIV_007000 | adp-ribosylation factor 4, related | protein length = 183 |
| NCLIV_050630 | H/ACA ribonucleoprotein complex subunit 2-like protein, related | protein length = 131 |
| NCLIV_052070 | hypothetical protein | protein length = 192 |
| NCLIV_023540 | putative aldo/keto reductase family oxidoreductase | protein length = 334 |
| NCLIV_066370 | hypothetical protein | protein length = 402 |
| NCLIV_057460 | Transketolase central region, related | protein length = 412 |
| NCLIV_019780 | putative KH domain containing protein | protein length = 762 |
| NCLIV_026100 | conserved hypothetical protein | protein length = 467 |
| NCLIV_019480 | proteasome A-type and B-type domain-containing protein | protein length = 267 |
| NCLIV_068640 | putative protein phosphatase 2C | protein length = 571 |
| NCLIV_065500 | conserved hypothetical protein | protein length = 311 |
| NCLIV_039280 | isocitrate dehydrogenase-like protein, related | protein length = 419 |
| NCLIV_014330 | Prolyl oligopeptidase (Precursor), related | protein length = 733 |
| NCLIV_010390 | novel protein (Zgc: 77804), related | protein length = 460 |
| NCLIV_004810 | conserved hypothetical protein | protein length = 590 |

TABLE D-continued

| Accession number[1] | Description[2] |
|---|---|
| NCLIV_035590 | conserved hypothetical protein | protein length = 742 |
| NCLIV_021410 | conserved hypothetical protein | protein length = 438 |
| NCLIV_016420 | putative pescadillo family protein | protein length = 727 |
| NCLIV_039820 | cDNA FLJ57348, highly similar to *Homo sapiens* hexokinase domain containing 1 (HKDC1), mRNA, related | protein length = 468 |
| NCLIV_003600 | putative ABC transporter | protein length = 833 |
| NCLIV_046890 | conserved hypothetical protein | protein length = 363 |
| NCLIV_067160 | hypothetical protein | protein length = 350 |
| NCLIV_055450 | putative FUN14 family domain-containing protein | protein length = 189 |
| NCLIV_011040 | putative N-ethylmaleimide-sensitive factor | protein length = 730 |
| NCLIV_018560 | putative ras-GTPase-activating protein binding protein | protein length = 848 |
| NCLIV_027230 | Dihydropteroate synthase, related | protein length = 669 |
| NCLIV_024220 | putative glycerol-3-phosphate dehydrogenase | protein length = 642 |
| NCLIV_003890 | conserved hypothetical protein | protein length = 384 |
| NCLIV_065820 | hypothetical protein | protein length = 482 |
| NCLIV_013130 | conserved hypothetical protein | protein length = 1139 |
| NCLIV_060920 | conserved hypothetical protein | protein length = 70 |
| NCLIV_046460 | conserved hypothetical protein | protein length = 92 |
| NCLIV_033810 | hypothetical protein | protein length = 232 |
| NCLIV_069460 | hypothetical protein | protein length = 107 |
| NCLIV_031440 | 60S ribosomal protein L38, related | protein length = 84 |
| NCLIV_036510 | hypothetical protein | protein length = 182 |
| NCLIV_025280 | conserved hypothetical protein | protein length = 294 |
| NCLIV_007105 | unspecified product | protein length = 171 |
| NCLIV_017460 | putative NUDIX hydrolase domain-containing protein | protein length = 237 |
| NCLIV_063760 | hypothetical protein | protein length = 408 |
| NCLIV_000280 | ranbp1 domain containing protein, related | protein length = 216 |
| NCLIV_030650 | putative 26S protease regulatory subunit 6b | protein length = 416 |
| NCLIV_024140 | hypothetical protein | protein length = 194 |
| NCLIV_035310 | putative inhibitor-1 of protein phosphatase type 2A | protein length = 289 |
| NCLIV_046540 | putative oligoendopeptidase F | protein length = 630 |
| NCLIV_066770 | putative seryl-tRNA synthetase | protein length = 480 |
| NCLIV_010650 | conserved hypothetical protein | protein length = 298 |
| NCLIV_056830 | putative 60S ribosomal protein L7a | protein length = 177 |
| NCLIV_053590 | WD-40 repeat protein, related | protein length = 802 |
| NCLIV_053640 | putative peroxidoxin 2 | protein length = 224 |
| NCLIV_054910 | conserved hypothetical protein | protein length = 377 |
| NCLIV_058360 | hypothetical protein | protein length = 299 |
| NCLIV_024380 | conserved hypothetical protein | protein length = 543 |
| NCLIV_049400 | Serine hydroxymethyltransferase, related | protein length = 499 |
| NCLIV_067490 | putative protein phosphatase 2C | protein length = 334 |
| NCLIV_023990 | Acyl carrier protein, related | protein length = 183 |
| NCLIV_058420 | conserved hypothetical protein | protein length = 190 |
| NCLIV_001360 | conserved hypothetical protein | protein length = 285 |
| NCLIV_036720 | CBR-CSN-5 protein, related | protein length = 314 |
| NCLIV_037060 | hypothetical protein | protein length = 578 |
| NCLIV_008960 | hypothetical protein | protein length = 499 |
| NCLIV_030470 | conserved hypothetical protein | protein length = 1270 |
| NCLIV_013910 | Pdcd4-prov protein, related | protein length = 504 |
| NCLIV_012500 | conserved hypothetical protein | protein length = 275 |
| NCLIV_029255 | unspecified product | protein length = 136 |
| NCLIV_056440 | Signal recognition particle GTPase, related | protein length = 583 |
| NCLIV_054410 | Calr protein, related | protein length = 599 |
| NCLIV_033275 | unspecified product | protein length = 805 |
| NCLIV_018460 | conserved hypothetical protein | protein length = 414 |
| NCLIV_046970 | conserved hypothetical protein | protein length = 1107 |
| NCLIV_048240 | hypothetical protein | protein length = 939 |
| NCLIV_021570 | conserved hypothetical protein | protein length = 783 |
| NCLIV_027770 | hypothetical protein | protein length = 617 |
| NCLIV_054460 | conserved hypothetical protein | protein length = 599 |
| NCLIV_022690 | conserved hypothetical protein | protein length = 314 |
| NCLIV_046580 | conserved hypothetical protein | protein length = 371 |
| NCLIV_036300 | conserved hypothetical protein | protein length = 141 |
| NCLIV_025600 | putative calmodulin | protein length = 142 |
| NCLIV_008990 | unspecified product | protein length = 294 |
| NCLIV_041870 | hypothetical protein | protein length = 736 |
| NCLIV_060890 | putative Ras family domain-containing protein | protein length = 244 |
| NCLIV_027270 | putative cell division protein | protein length = 959 |
| NCLIV_047010 | conserved hypothetical protein | protein length = 499 |
| NCLIV_044340 | conserved hypothetical protein | protein length = 2073 |
| NCLIV_008900 | yali0d05697p, related | protein length = 51 |
| NCLIV_051960 | conserved hypothetical protein | protein length = 137 |
| NCLIV_058810 | superoxide dismutase | protein length = 201 |
| NCLIV_006170 | phosphoglycerate mutase, related | protein length = 252 |
| NCLIV_054840 | conserved hypothetical protein | protein length = 226 |
| NCLIV_016430 | conserved hypothetical protein | protein length = 264 |
| NCLIV_045530 | conserved hypothetical protein | protein length = 104 |
| NCLIV_007180 | hypothetical protein | protein length = 91 |

TABLE D-continued

| Accession number[1] | Description[2] |
|---|---|
| NCLIV_020880 | hypothetical protein | protein length = 133 |
| NCLIV_023130 | conserved hypothetical protein | protein length = 438 |
| NCLIV_003420 | putative elongation factor ts | protein length = 564 |
| NCLIV_048580 | hypothetical protein | protein length = 420 |
| NCLIV_065910 | conserved hypothetical protein | protein length = 309 |
| NCLIV_007120 | hypothetical protein | protein length = 762 |
| NCLIV_004340 | hypothetical protein | protein length = 232 |
| NCLIV_044820 | conserved hypothetical protein | protein length = 271 |
| NCLIV_044850 | conserved hypothetical protein | protein length = 447 |
| NCLIV_054510 | putative heat shock protein 90 | protein length = 975 |
| NCLIV_026520 | conserved hypothetical protein | protein length = 751 |
| NCLIV_006940 | conserved hypothetical protein | protein length = 389 |
| NCLIV_049920 | conserved hypothetical protein | protein length = 914 |
| NCLIV_052000 | putative DNA replication licensing factor | protein length = 1054 |
| NCLIV_032160 | putative UBA/TS-N domain-containing protein | protein length = 757 |
| NCLIV_001930 | conserved hypothetical protein | protein length = 1186 |
| NCLIV_032830 | hypothetical protein | protein length = 1130 |
| NCLIV_032180 | GK24228, related | protein length = 3393 |
| NCLIV_052270 | conserved hypothetical protein | protein length = 105 |
| NCLIV_068620 | putative Ribosome associated membrane domain-containing protein | protein length = 68 |
| NCLIV_025130 | Translation initiation factor 1A (AeIF-1A), related | protein length = 161 |
| NCLIV_049080 | hypothetical protein | protein length = 170 |
| NCLIV_054280 | conserved hypothetical protein | protein length = 84 |
| NCLIV_045490 | conserved hypothetical protein | protein length = 122 |
| NCLIV_038830 | sm protein, related | protein length = 121 |
| NCLIV_031530 | hypothetical protein | protein length = 187 |
| NCLIV_038390 | hypothetical protein | protein length = 112 |
| NCLIV_013780 | hypothetical protein | protein length = 236 |
| NCLIV_054960 | putative vacuolar ATP synthase subunit f | protein length = 127 |
| NCLIV_055190 | putative myosin light chain TgMLC1 | protein length = 137 |
| NCLIV_030910 | LRRGT00025, related | protein length = 84 |
| NCLIV_004570 | hypothetical protein | protein length = 151 |
| NCLIV_003110 | conserved hypothetical protein | protein length = 211 |
| NCLIV_024600 | hypothetical protein | protein length = 158 |
| NCLIV_051040 | conserved hypothetical protein | protein length = 269 |
| NCLIV_059830 | conserved hypothetical protein | protein length = 188 |
| NCLIV_046140 | conserved hypothetical protein | protein length = 213 |
| NCLIV_008650 | hypothetical protein | protein length = 227 |
| NCLIV_014050 | conserved hypothetical protein | protein length = 303 |
| NCLIV_068650 | putative endoplasmic reticulum retention receptor | protein length = 224 |
| NCLIV_065410 | putative ctr copper transporter domain-containing protein | protein length = 239 |
| NCLIV_037400 | putative la domain-containing protein | protein length = 559 |
| NCLIV_030630 | p25-alpha family protein, related | protein length = 169 |
| NCLIV_046900 | hypothetical protein | protein length = 253 |
| NCLIV_059790 | putative proteasome subunit alpha type 3 | protein length = 260 |
| NCLIV_010050 | srs domain-containing protein | protein length = 459 |
| NCLIV_066820 | putative proteasome activator subunit | protein length = 267 |
| NCLIV_061340 | hypothetical protein | protein length = 187 |
| NCLIV_063610 | conserved hypothetical protein | protein length = 382 |
| NCLIV_003990 | conserved hypothetical protein | protein length = 298 |
| NCLIV_037540 | YOR039Wp-like protein, related | protein length = 320 |
| NCLIV_028870 | Peptidylprolyl isomerase D (Cyclophilin D), related | protein length = 529 |
| NCLIV_058310 | putative vacuolar ATP synthase subunit c | protein length = 409 |
| NCLIV_026040 | putative structure specific recognition protein I | protein length = 538 |
| NCLIV_024990 | conserved hypothetical protein | protein length = 112 |
| NCLIV_046390 | hypothetical protein | protein length = 221 |
| NCLIV_049110 | hypothetical protein | protein length = 354 |
| NCLIV_031030 | conserved hypothetical protein | protein length = 379 |
| NCLIV_043070 | hypothetical protein | protein length = 244 |
| NCLIV_011840 | hypothetical protein | protein length = 285 |
| NCLIV_060330 | putative molybdopterin cofactor sulfurase | protein length = 756 |
| NCLIV_053970 | conserved hypothetical protein | protein length = 430 |
| NCLIV_034650 | conserved hypothetical protein | protein length = 306 |
| NCLIV_045860 | hypothetical protein | protein length = 450 |
| NCLIV_029800 | conserved hypothetical protein | protein length = 155 |
| NCLIV_045190 | Proteophosphoglycan ppg1, related protein length = 1357 |
| NCLIV_005550 | hypothetical protein | protein length = 502 |
| NCLIV_052950 | SRS domain-containing protein | protein length = 366 |
| NCLIV_065640 | putative Rhoptry kinase family protein, truncated (incomplete catalytic triad) | protein length = 538 |
| NCLIV_033030 | conserved hypothetical protein | protein length = 1264 |
| NCLIV_046620 | *Plasmodium vivax* PV1H14060_P, related | protein length = 785 |
| NCLIV_069400 | hypothetical protein, conserved | protein length = 208 |
| NCLIV_009170 | proteasome (Prosome, macropain) subunit, beta type, 1, related | protein length = 191 |
| NCLIV_022080 | hypothetical protein | protein length = 212 |
| NCLIV_062220 | Glutaminyl-tRNA synthetase, related | protein length = 402 |
| NCLIV_049150 | conserved hypothetical protein | protein length = 1134 |

TABLE D-continued

| Accession number[1] | Description[2] |
|---|---|
| NCLIV_056560 | putative DEAD/DEAH box helicase \| protein length = 694 |
| NCLIV_045350 | conserved hypothetical protein \| protein length = 1000 |
| NCLIV_024360 | hypothetical protein \| protein length = 763 |
| NCLIV_0155 | alpha/beta hydrolase fold domain containing protein \| protein length = 744 |
| NCLIV_033090 | putative rhoGAP protein \| protein length = 525 |
| NCLIV_002660 | hypothetical protein \| protein length = 262 |
| NCLIV_067260 | Diaminopimelate decarboxylase protein, related \| protein length = 563 |
| NCLIV_032250 | conserved hypothetical protein \| protein length = 307 |
| NCLIV_016220 | unspecified product \| protein length = 574 |
| NCLIV_053680 | hypothetical protein \| protein length = 665 |
| NCLIV_035750 | putative vacuolar protein sorting-associated protein \| protein length = 658 |
| NCLIV_040040 | grpe protein homolog, related \| protein length = 361 |
| NCLIV_004680 | conserved hypothetical protein \| protein length = 703 |
| NCLIV_014450 | Phosphoglucomutase 2, related protein length = 719 |
| NCLIV_016520 | hypothetical protein \| protein length = 779 |
| NCLIV_013840 | hypothetical protein \| protein length = 792 |
| NCLIV_062610 | Zdhhc9 protein, related protein length = 391 |
| NCLIV_008860 | hypothetical protein \| protein length = 415 |
| NCLIV_060110 | conserved hypothetical protein \| protein length = 895 |
| NCLIV_063620 | conserved hypothetical protein \| protein length = 450 |
| NCLIV_051920 | conserved hypothetical protein \| protein length = 944 |
| NCLIV_060990 | hypothetical protein \| protein length = 918 |
| NCLIV_063490 | conserved hypothetical protein \| protein length = 520 |
| NCLIV_068580 | hypothetical protein \| protein length = 603 |
| NCLIV_065770 | putative nuclear cap binding protein \| protein length = 1217 |
| NCLIV_051440 | putative WD-40 repeat protein \| protein length = 1433 |
| NCLIV_047350 | conserved hypothetical protein \| protein length = 713 |
| NCLIV_060640 | putative Gpi16 subunit, GPI transamidase domain-containing protein \| protein length = 717 |
| NCLIV_004700 | conserved hypothetical protein \| protein length = 1670 |
| NCLIV_060900 | conserved hypothetical protein \| protein length = 1938 |
| NCLIV_061290 | putative DEAD/DEAH box RNA helicase \| protein length = 969 |
| NCLIV_043870 | conserved hypothetical protein \| protein length = 1049 |
| NCLIV_047370 | conserved hypothetical protein \| protein length = 2085 |
| NCLIV_055820 | hypothetical protein \| protein length = 1641 |
| NCLIV_003410 | putative HECT-domain (ubiquitin-transferase) containing protein\| protein length = 11957 |
| NCLIV_003470 | putative thrombospondin type 1 domain-containing protein\| protein length = 822 |
| NCLIV_006290 | conserved hypothetical protein\| protein length = 4189 |
| NCLIV_0153 | longevity-assurance (LAG1) domain-containing protein\| protein length = 4721 |
| NCLIV_015950 | conserved hypothetical protein\| protein length = 1421 |
| NCLIV_019520 | MGC83258 protein, related\| protein length = 16227 |
| NCLIV_020980 | hypothetical protein \| protein length = 1988 |
| NCLIV_026590 | putative DEAD/DEAH box helicase \| protein length = 1808 |
| NCLIV_032810 | conserved hypothetical protein \| protein length = 1531 |
| NCLIV_0376 | elongation factor Tu GTP-binding domain-containing protein \| protein length = 1737 |
| NCLIV_038990 | conserved hypothetical protein \| protein length = 522 |
| NCLIV_040650 | conserved hypothetical protein \| protein length = 2379 |
| NCLIV_042610 | conserved hypothetical protein \| protein length = 2636 |
| NCLIV_045300 | Chloroquine resistance marker protein, related \| protein length = 4004 |
| NCLIV_046940 | putative PWWP domain-containing protein \| protein length = 2083 |
| NCLIV_048380 | conserved hypothetical protein \| protein length = 2277 |
| NCLIV_056570 | Collagen alpha-1(III) chain (Precursor), related \| protein length = 2814 |
| NCLIV_057020 | conserved hypothetical protein \| protein length = 1546 |
| NCLIV_058800 | hypothetical protein \| protein length = 962 |
| NCLIV_059730 | conserved hypothetical protein \| protein length = 724 |
| NCLIV_059960 | conserved hypothetical protein \| protein length = 5715 |
| NCLIV_064260 | putative WD domain-containing protein \| protein length = 3128 |
| NCLIV_064490 | putative phosphatidylinositol 3-and 4-kinase domain-containing protein \| protein length = 1726 |
| NCLIV_070170 | hypothetical protein \| protein length = 8792 |
| NCLIV_001280 | putative ribokinase \| protein length = 440 |
| NCLIV_001290 | conserved hypothetical protein \| protein length = 1221 |
| NCLIV_001550 | putative ribonucleoside-diphosphate reductase, large subunit \| protein length = 886 |
| NCLIV_001770 | putative DNAK family domain containing protein \| protein length = 802 |
| NCLIV_001890 | hypothetical protein \| protein length = 975 |
| NCLIV_002680 | agap001651-PA, related \| protein length = 521 |
| NCLIV_004200 | hypothetical protein \| protein length = 1734 |
| NCLIV_004250 | putative nuclear RNA binding protein protein \| length = 373 |
| NCLIV_005500 | conserved hypothetical protein \| protein length = 1136 |
| NCLIV_005770 | hypothetical protein \| protein length = 1153 |
| NCLIV_005860 | IMP-specific 5'-nucleotidase, related \| protein length = 656 |
| NCLIV_006150 | tRNAbinding domain containing protein, related \| protein length = 434 |
| NCLIV_006620 | trehalose-6-phosphate synthase of likely plant origin, related \| protein length = 1215 |
| NCLIV_006850 | unspecified product \| protein length = 2418 |
| NCLIV_007580 | hypothetical protein \| protein length = 1601 |
| NCLIV_007730 | valyl-tRNAsynthetase, mitochondrial, related \| protein length = 1057 |
| NCLIV_007860 | hypothetical protein \| protein length = 570 |

TABLE D-continued

| Accession number[1] | Description[2] |
|---|---|
| NCLIV_008100 | putative IMPortin-alpha re-exporter | protein length = 1054 |
| NCLIV_009300 | gk17769, related | protein length = 619 |
| NCLIV_010370 | ubiquitin carrier protein, related | protein length = 147 |
| NCLIV_010960 | putative phosphoglucomutase | protein length = 647 |
| NCLIV_011120 | malate dehydrogenase, related | protein length = 316 |
| NCLIV_011740 | conserved hypothetical protein | protein length = 285 |
| NCLIV_011830 | conserved hypothetical protein | protein length = 191 |
| NCLIV_012700 | putative TCP-1/cpn60 family chaperonin | protein length = 557 |
| NCLIV_012860 | Leucyl-tRNA synthetase 2, related | protein length = 1160 |
| NCLIV_015460 | hypothetical protein | protein length = 238 |
| NCLIV_016000 | conserved hypothetical protein | protein length = 1393 |
| NCLIV_016150 | Serine--pyruvate transaminase, related | protein length = 381 |
| NCLIV_017040 | Phosphofructokinase, related | protein length = 1400 |
| NCLIV_017470 | Proteasome subunit alpha type, related | protein length = 296 |
| NCLIV_018300 | HIT family protein, related | protein length = 153 |
| NCLIV_019960 | putative lysyl-tRNA synthetase | protein length = 598 |
| NCLIV_020310 | putative fructose-1,6-bisphosphatase | protein length = 387 |
| NCLIV_021260 | hypothetical protein | protein length = 567 |
| NCLIV_022000 | putative para-aminobenzoate synthase | protein length = 716 |
| NCLIV_022400 | hypothetical protein | protein length = 549 |
| NCLIV_022550 | GK15875, related | protein length = 456 |
| NCLIV_028820 | hypothetical protein | protein length = 587 |
| NCLIV_028830 | Glucose-6-phosphate isomerase, related | protein length = 481 |
| NCLIV_029720 | putative eukaryotic translation intiation factor | protein length = 860 |
| NCLIV_029970 | tRNA synthetase Gly, related | protein length = 716 |
| NCLIV_030120 | putative importin beta-3 subunit | protein length = 1166 |
| NCLIV_030290 | putative transaldolase | protein length = 377 |
| NCLIV_030480 | hypothetical protein | protein length = 414 |
| NCLIV_031320 | conserved hypothetical protein | protein length = 1583 |
| NCLIV_031560 | Arsenite-activated ATPase ArsA, related | protein length = 333 |
| NCLIV_031730 | putative translational activator | protein length = 3415 |
| NCLIV_031750 | putative importin | protein length = 1199 |
| NCLIV_032130 | conserved hypothetical protein | protein length = 961 |
| NCLIV_032240 | Catalase (EC 1.11.1.6), related | protein length = 516 |
| NCLIV_032320 | hypothetical protein | protein length = 641 |
| NCLIV_032950 | putative deoxyuridine 5'-triphosphate nucleotidohydrolase | protein length = 188 |
| NCLIV_033140 | hypothetical protein | protein length = 125 |
| NCLIV_033830 | hypothetical protein | protein length = 380 |
| NCLIV_034160 | Glutamine synthetase, related | protein length = 455 |
| NCLIV_039940 | hypothetical protein | protein length = 395 |
| NCLIV_040730 | ypothetical protein | protein length = 750 |
| NCLIV_041690 | ubiquitin carboxyl-terminal hydrolase, related | protein length = 2325 |
| NCLIV_041850 | putative Hsp20/alpha crystallin domain-containing protein | protein length = 271 |
| NCLIV_041900 | phosphoenolpyruvate carboxykinase (ATP), related | protein length = 582 |
| NCLIV_042265 | hypothetical protein | protein length = 483 |
| NCLIV_042370 | hypothetical protein | protein length = 246 |
| NCLIV_042400 | macrophage migration inhibitory factor, related | protein length = 116 |
| NCLIV_042500 | ubiquitin-activating enzyme E1, related | protein length = 1100 |
| NCLIV_043140 | putative aspartate carbamoyltransferase | protein length = 363 |
| NCLIV_043320 | rna recognition motif (RRM)-containing protein, related | protein length = 555 |
| NCLIV_044270 | hypothetical protein | protein length = 723 |
| NCLIV_045170 | hypothetical protein | protein length = 272 |
| NCLIV_045980 | conserved hypothetical protein | protein length = 170 |
| NCLIV_048530 | GK19179, related | protein length = 2878 |
| NCLIV_048670 | cDNA FLJ55447, highly similar to ATP-citrate synthase, related | protein length = 1295 |
| NCLIV_048930 | hypothetical protein | protein length = 1146 |
| NCLIV_050000 | putative deoxyhypusine synthase, related | protein length = 429 |
| NCLIV_051000 | Ethylene-inducible protein hever, related | protein length = 307 |
| NCLIV_051530 | hypothetical protein | protein length = 258 |
| NCLIV_051590 | putative GTP binding protein | protein length = 396 |
| NCLIV_051620 | putative 4'-phosphopantetheinyl transferase | protein length = 350 |
| NCLIV_052340 | hypothetical protein | protein length = 230 |
| NCLIV_052870 | conserved hypothetical protein | protein length = 2579 |
| NCLIV_052980 | hypothetical protein | protein length = 392 |
| NCLIV_053190 | hypothetical protein | protein length = 674 |
| NCLIV_053860 | MGC84926 protein, related | protein length = 528 |
| NCLIV_054150 | Ubiquitin-conjugating enzyme, related | protein length = 140 |
| NCLIV_054700 | putative uridine phosphorylase | protein length = 302 |
| NCLIV_055070 | Ubiquitin carboxyl-terminal hydrolase, related | protein length = 627 |
| NCLIV_055170 | DnaJ domain containing protein, related | protein length = 426 |
| NCLIV_055230 | putative serine/threonine protein phosphatase | protein length = 475 |
| NCLIV_055660 | conserved hypothetical protein | protein length = 377 |
| NCLIV_055800 | Serine/threonine protein phosphatase 5, related | protein length = 598 |
| NCLIV_056020 | hypothetical protein | protein length = 248 |
| NCLIV_056140 | conserved hypothetical protein | protein length = 2723 |
| NCLIV_057250 | conserved hypothetical protein | protein length = 215 |
| NCLIV_058000 | putative alanine dehydrogenase | protein length = 390 |

TABLE D-continued

| Accession number[1] | Description[2] |
|---|---|
| NCLIV_058010 | conserved hypothetical protein \| protein length = 774 |
| NCLIV_059620 | conserved hypothetical protein \| protein length = 400 |
| NCLIV_059920 | putative eukaryotic initiation factor-2B gamma subunit \| protein length = 528 |
| NCLIV_060470 | hypothetical protein \| protein length = 671 |
| NCLIV_060600 | 6-phosphogluconate dehydrogenase, decarboxylating, related \| protein length = 505 |
| NCLIV_061050 | hypothetical protein \| protein length = 1034 |
| NCLIV_061600 | hypothetical protein \| protein length = 469 |
| NCLIV_061720 | hypothetical protein \| protein length = 3385 |
| NCLIV_062230 | Glutaminyl-tRNA synthetase, related \| protein length = 525 |
| NCLIV_063380 | hypothetical protein \| protein length = 439 |
| NCLIV_065240 | Fructose-1 6-biphosphatase, related \| protein length = 349 |
| NCLIV_065280 | Proliferating cell nuclear antigen, related \| protein length = 321 |
| NCLIV_065390 | Bifunctional dihydrofolate reductase-thymidylate synthase, related \| protein length = 690 |
| NCLIV_065690 | hypothetical protein \| protein length = 1117 |
| NCLIV_066410 | GG10762, related \| protein length = 363 |
| NCLIV_066760 | Translationally-controlled tumor protein, related \| protein length = 171 |
| NCLIV_066920 | hypothetical protein \| protein length = 430 |
| NCLIV_067980 | Proteasome subunit alpha type, related \| protein length = 247 |
| NCLIV_069700 | hypothetical protein, conserved \| protein length = 2310 |

[1]Accession number for the identified protein in ToxoDB database (ToxoDB-13.0_NcaninumLIV_AnnotatedProteins; 7122 sequences; Date 9 Feb. 2015) (Gajria et al., 2008, Nucleic Acids Res. 36; Database issue: D553-556).
[2]Protein description in ToxoDB database (ToxoDB-13.0_NcaninumLIV_AnnotatedProteins; 7122 sequences; Date 9 Feb. 2015) (Gajria et al., 2008, Nucleic Acids Res. 36; Database issue: D553-556): putative protein identification and amino acid protein length.

The identification of the proteins of Table D may be carried out as described in Example 4 below in the present specification (LC-MS/MS analysis, Examples 4.1.2 (Sample preparation for LC-MS/MS experiments), 4.1.3. (Liquid Chromatography Tandem Mass Spectrometry (LC-MS/MS)), 4.1.4. (Peptide Identification by Mascot Database Searches), 4.1.5. (Protein relative quantification), 4.1.6. (In Silico analysis of diferentially abundant identified proteins), and 4.2.1 (Raw LC-MS data analysis)).

In a preferred embodiment, the protein composition of the present invention comprises (or, alternatively, consists of) at least one, and preferably all, of the proteins listed in Table D. Preferably, the protein composition of the present invention comprises (or, alternatively, consists of) at least one such as 1, 2, 3, 4, 5, 6, 7, 8, 9, 10, 15, 20, 30, 40, 50, 60, 70, 75, 80, 90, 100, 125, 150, 175, 200, 225, 250, 275, 280, 300, 325, 350, 375, 400, 450, 500, 550, 600, 650, 700, 750, 800, 850, 900, 950, 1000, 1022 of the proteins as listed in Table D (Example 4.2.1 of the present specification). Preferably, the protein composition of the present invention comprises (or, alternatively, consists of) all of the proteins listed in Table D, which may be identified as described in Example 4 of the present specification (LC-MS/MS analysis, Examples 4.1.2 (Sample preparation for LC-MS/MS experiments), 4.1.3. (Liquid Chromatography Tandem Mass Spectrometry (LC-MS/MS)), 4.1.4. (Peptide Identification by Mascot Database Searches), 4.1.5. (Protein relative quantification) 4.1.6. (In Silico analysis of diferentially abundant identified proteins), and 4.2.1 (Raw LC-MS data analysis)).

In a preferred embodiment, the protein composition of the present invention comprises (or, alternatively, consists of) at least one protein of the proteins listed in Table D, as described above and, in addition, the protein composition of the present invention comprises (or, alternatively, consists of) at least one of the proteins as listed in Table A above in an amount of at least about 2 times (fold change) higher than the same protein present in the WTE, as determined by relative quantification by quantitative label-free LC-MS/MS analysis, as described in the previous embodiment.

Accordingly, the composition of the present invention may comprise at least one such as 1, 2, 3, 4, 5, 6, 7, 8, 9, 10, 15, 20, 30, 40, 50, 60, 70, 75, 80, 90, 100, 125, 150, 175, 200, 225, 250, 275, 280, 300, 325, 350, 375, 400, 450, 500, 550, 600, 650, 700, 750, 800, 850, 900, 950, 1000, 1022 (and preferably all) of the proteins as listed in Table D and in addition, at least one such as 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53 (and preferably all) of the proteins as listed in Table A above in an amount of at least about 2 times (fold change) higher than the same protein present in the WTE, as determined by relative quantification by quantitative label-free LC-MS/MS analysis. The WTE and the quantification of the proteins is performed as described in Example 4 of the present specification.

In a preferred embodiment, the protein composition of the present invention comprises (or, alternatively, consists of) at least one protein of the proteins listed in Table D, as described above and, in addition, the protein composition of the present invention comprises (or, alternatively, consists of) at least one of the proteins as listed in Table B above, in an amount defined as indicated in the column "fold change" in Table B higher than the same protein present in the whole tachyzoite extract, as determined by relative quantification by quantitative label-free LC-MS/MS analysis.

Accordingly, the protein composition of the present invention may comprise at least one such as 1, 2, 3, 4, 5, 6, 7, 8, 9, 10, 15, 20, 30, 40, 50, 60, 70, 75, 80, 90, 100, 125, 150, 175, 200, 225, 250, 275, 280, 300, 325, 350, 375, 400, 450, 500, 550, 600, 650, 700, 750, 800, 850, 900, 950, 1000, 1022 (and preferably all) of the proteins as listed in Table D and in addition, at least one such as 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53 (and preferably all) of the proteins as listed in Table B above in an amount defined as indicated in the column "fold change" in Table B higher than the same protein present in the WTE, as determined by relative quantification by quantitative label-free LC-MS/MS analysis.

In a preferred embodiment, the protein composition of the present invention comprises (or, alternatively, consists of) at least one protein of the proteins listed in Table D, as described above and, in addition, the protein composition of the present invention comprises (or, alternatively, consists of) at least one of the proteins as listed in Table C above in an amount of at least about 1.5 times (fold change) higher than the same protein present in the WTE, as determined by relative quantification by quantitative label-free LC-MS/MS analysis, as described in the previous embodiment.

Accordingly, the composition of the present invention may comprise at least one such as 1, 2, 3, 4, 5, 6, 7, 8, 9, 10, 15, 20, 30, 40, 50, 60, 70, 75, 80, 90, 100, 125, 150, 175, 200, 225, 250, 275, 280, 300, 325, 350, 375, 400, 450, 500, 550, 600, 650, 700, 750, 800, 850, 900, 950, 1000, 1022 (and preferably all) of the proteins as listed in Table D and in addition, at least one such as 1, 2, 3, 4, 5, 6, 7, 8, 9, 10, 15, 20, 30, 40, 50, 60, 70, 75, 80, 90, 100, 125, 150, 175, 200, 225, 250, 261 (and preferably all) of the proteins as listed in Table C above in an amount of at least about 1.5 times (fold change) higher than the same protein present in the WTE, as determined by relative quantification by quantitative label-free LC-MS/MS analysis.

In all the cases above, as already indicated, the extract preparation for LC-MS/MS experiments and the analyses may be performed as described in Examples 4.1.1. (*Neospora caninum* cultures, tachyzoite production for EAE and WTE, and EAE and WTE production), 4.1.2. (Sample preparation for LC-MS/MS experiments), 4.1.3. (Liquid Chromatography Tandem Mass Spectrometry (LC-MS/MS)), 4.1.4. (Peptide Identification by Mascot Database Searches), 4.1.5. (Protein relative quantification), 4.1.6. (In Silico analysis of diferentially abundant identified proteins), 4.2.1 (Raw LC-MS Data Analysis) and 4.2.2 (Relative quantification between EAE and WTE).

Method of Producing a Protein Composition

In addition, the present invention refers to a method for producing a protein composition (the protein composition of the invention) comprising (or, alternatively, consisting of) the following steps:
 a. Providing *Neospora* cells in a hypertonic solution;
 b. Centrifuging the solution obtained in step (a) under conditions suitable for separating the soluble fraction (supernatant) and insoluble fraction (precipitate);
 c. Recovering the precipitate from step (b); and
 d. Mixing said precipitate with a non-ionic surfactant.

Preferably, the *Neospora* cells belong to the species *Neospora caninum*, more preferably to the Nc-Spain 7 isolate of *N. caninum* (Regidor-Cerrillo et al., 2008, Parasitology 135(14):1651-1659) (deposited on 20 Sep. 2005, by Prof. Luis Miguel Ortega Mora, Grupo de salud veterinaria y zoonosis, Departamento de sanidad animal—Facultad de veterinaria, Universidad Complutense de Madrid, Avenida Puerta de Hierron S/N, Ciudad Universitaria, 28040, Madrid), according to the provisions of the Budapest Treaty on the International Recognition of the Deposit of Microorganisms for the Purposes of Patent Procedure, in the Culture Collection of Algae and Protozoa (CCAP) located in the Dunstaffnage Marine Laboratory, Dunbeg, OBAN, Argyll PA37 1QA, United Kingdom, with accession number CCAP 2051/1). Preferably, the *Neospora* cells are tachyzoites, preferably tachyzoites of *N. caninum*, preferably tachyzoites from the Nc-Spain 7 isolate of *N. caninum*.

As used in the present invention, a hypertonic solution may be defined as a solution that has higher osmotic pressure or has more concentration of solutes than other solution to which it is compared, in this case the solute concentration higher than solution inside the cells, the *Neospora* tachyzoite.

Preferably, the hypertonic solution comprises osmotic shock elements such as sucrose and/or sorbitol, and/or mannitol. If the hypertonic solution comprises (or, alternatively, consists of) sucrose, the amount of sucrose is preferably about 10-80% (w/v in PBS), more preferably about 15-40% (w/v in PBS), even more preferably about 20% (w/v in PBS).

Preferably, the centrifugation takes place at about 8,000-15,000×g, during about 40-90 min and at a temperature of about 1-10° C., preferably at about 10,000×g, during about 60 min at about 4° C.

As used herein, non-ionic surfactants are surfactants comprising a polar, but uncharged hydrophilic group. Preferably, the non-ionic surfactant is selected from the group consisting of Cetomacrogol 1000, Cetostearyl alcohol, Cetyl alcohol, Cocamide DEA, Cocamide MEA, Decyl glucoside, IGEPAL CA-630, Isoceteth-20, Lauryl glucoside, Monolaurin, Narrow range ethoxylate, Nonidet P-40, Nonoxynol-9, Nonoxynols, NP-40. Octaethylene glycol monododecyl ether, N-Octyl beta-D-thioglucopyranoside, Octyl glucoside, Oleyl alcohol, Pentaethylene glycol monododecyl ether, Poloxamer, Poloxamer 407, Polyglycerol polyricinoleate, Polysorbate, Polysorbate 20, Polysorbate 80 (Polyoxyethylene (20) sorbitan monooleate), Sorbitan monostearate, Sorbitan tristearate, Stearyl alcohol, Tween 80, Triton X-114, Tween 20 (Polyoxyethylene (20) sorbitan monolaurate) and Triton X-100. Preferably, the non-ionic surfactant is selected from the group consisting of Polysorbate 80, Triton X-100, Triton X-114 and Tween 20. Even more preferably, the non-ionic surfactant is Triton X-100.

In a preferred embodiment, the method of the present invention further comprises the step (e) of homogenising the mixture obtained after step (d). Homogenising procedures includes those carried out by physical methods such as sonication, hydrodynamic cavitation and high pressure homogenization. Homogenization methods are described, e.g., in Balasundaram et al., 2009, Trends in Biotechnology 27(8): 477-485.

The present invention further provides a protein composition (directly) obtainable or obtained by the method according to the present invention.

Pharmaceutical Composition or Pharmaceutical Formula

The present invention further provides a pharmaceutical composition (or pharmaceutical formula) comprising the protein composition of the present invention. Preferably, the pharmaceutical composition (or pharmaceutical formula) comprises one or more excipients and/or one or more pharmaceutically acceptable carriers or diluents. Suitable pharmaceutically acceptable carrier or diluent are for example water, culture fluid, a solution of physiological salt concentration and/or stabilisers such as SPGA, carbohydrates (e.g., sorbitol, mannitol, starch, sucrose, glucose, dextran), proteins such as albumin or casein, protein containing agents such as bovine serum or skimmed milk and buffers (e.g., phosphate buffer).

The pharmaceutical composition (or pharmaceutical formula) of the present invention may comprise immunomodulant-immunoestimulant substances (i.e. substances that stimulate the immune system by inducing activation or increasing activity of any of its components), such as cytokines.

Vaccine

In one embodiment, the pharmaceutical composition or pharmaceutical formula of the invention is a vaccine. In the context of the present invention, the term "vaccine" refers to an antigenic preparation used to establish immune system response to a disease. The vaccines described herein can be used against pathogenic organisms or to induce tolerance against antigens which cause allergies or against autoantigens triggering autoimmune diseases. Preferably, the vaccine according to the present invention is used in the treatment or prevention of infections caused by *Neospora*, such as *Neospora caninum* and/or *Neospora hughesi*.

The vaccine may preferably comprise one or more adjuvants. Vaccine adjuvants are chemicals, microbial components, or mammalian proteins that enhance the immune response to vaccine antigens (Spickler & Roth, 2003, J. Vet. Intern. Med. 17: 273-281, which reviews modes of action and adverse effects of adjuvants in veterinary vaccines). The adjuvant useful in the context of the present invention may be an inorganic or organic chemical, macromolecule or whole cells of certain killed bacteria which enhances the immune response to given antigen. In the context of the present invention, the adjuvant that may be present in the composition of the invention can be any suitable adjuvant which e g enhances, accelerates and prolongs the specific immune response as known in the current art.

Major type of adjuvants comprise alum and calcium salts, oil emulsion adjuvants (comprising a mixture of oil and aqueous phases, stabilized by a surfactant), liposomes and archaeosomes, nanoparticles and microparticles, saponins, immune-stimulating complexes, nonionic block copolymers, carrier proteins (such as diphtheria or tetanus toxoid, KLH, and bovine serum albumin), bacterial products and their derivatives, derivatized polysaccharides, cytokines, complement derivatives (Spickler & Roth, 2003, J. Vet. Intern. Med. 17:273-281).

Adjuvants useful in the context of the present invention may include for instance:

Mineral salts, e.g., aluminium hydroxide and aluminium or calcium phosphate gels.

Oil emulsions and surfactant based formulations, e.g., MF59 (microfluidised detergent stabilised oil-in-water emulsion), QS21 (purified saponin), AS02 [SBAS2] (oil-in-water emulsion+MPL+QS-21), Montanide™ ISA-51, ISA-720, IMS (stabilised water-in-oil emulsion).

Particulate adjuvants, e.g., virosomes (unilamellar liposomal vehicles incorporating influenza haemagglutinin), AS04 ([SBAS4] Al salt with MPL), ISCOMS (structured complex of saponins and lipids), polylactide co-glycolide (PLG).

Microbial derivatives (natural and synthetic), e.g., monophosphoryl lipid A (MPL), Detox (MPL+*M. phlei* cell wall skeleton), AGP [RC-529] (synthetic acylated monosaccharide), DC_Chol (lipoidal immunostimulators able to self organise into liposomes), OM-174 (lipid A derivative), CpG motifs (synthetic oligonucleotides containing immunostimulatory CpG motifs), modified LT and CT (genetically modified bacterial toxins to provide non-toxic adjuvant effects).

Endogenous immunomodulators (immunomodulant-immunoestimulant substances), such as cytokines, e.g., GM-CSF or IL-12 (cytokines that can be administered either as protein or plasmid encoded), Immudaptin (C3d tandem array)

Inert vehicles, such as gold particles towards the desired response to vaccine antigens.

Preferably, the vaccine of the invention comprises one or more adjuvants, preferably a saponin adjuvant. Saponins are complex chemical adjuvants extracted from plants, most often the tree *Quillaia saponaria*. The crude extract from this tree is called saponin. Sun et al. (2009, Vaccine 27(12): 1787-1796) reviews advances in saponin-based adjuvants.

The saponin may be any saponin suitable to act as an adjuvant. Preferably, the saponin is QuilA® (generically known as spijoside or *Quillaja* A or Iscotec AB) a saponin obtained from *Quillaja saponaria* (soap bark tree or Soapbark).

The adjuvant is preferably present in the final pharmaceutical composition (or pharmaceutical formula) in a concentration of about 0.001 to 50% w/v with respect to the final volume of the composition, preferably 0.001%, 0.005%, 0.01%, 0.05%, 0.1%, 0.2%, 0.5%, 1%, 10%, 50% or more (w/v, i.e. weight in grams contained in a final volume of 100 ml). More preferably, the concentration of adjuvant in the final formula is about 0.01% w/v with respect to the final volume (w/v, i.e. weight in grams contained in a final volume of 100 ml).

Use of the Protein Composition and/or the Pharmaceutical Composition (or Pharmaceutical Formula) and/or the Vaccine of the Invention as a Medicament (or Medicinal Product).

Preferably, the protein composition and/or the pharmaceutical formula and/or the vaccine according to the present invention are used as a medicament (medicinal product), preferably in a method of therapeutic treatment (after infection or after the clinical manifestation of the disease caused by the infection) and/or prophylactic treatment (before infection or before the clinical manifestation of the disease caused by the infection) of infections caused by *Neospora*, such as infections caused by *Neospora caninum* and/or *Neospora hughes*, preferably, infections caused by *Neospora caninum*. Neosporosis is caused by infection with, e.g., the protozoa *Neospora caninum*.

The protein composition and/or the pharmaceutical composition (or the pharmaceutical formula) and/or the vaccine according to the present invention may be formulated in any pharmaceutical formulation able to achieve the desired effect.

For example, the protein composition and/or the pharmaceutical formula (or pharmaceutical composition) and/or the vaccine according to the present invention may be formulated as tablets, capsules, pills, emulsions, suspensions or solutions.

Preferably, the protein composition and/or the pharmaceutical formula (or pharmaceutical composition) and/or the vaccine according to the present invention comprises (or, alternatively, consists of) an amount of about 0.0001% to about 0.5% w/v (w/v, i.e. weight in grams contained in a final volume of 100 ml) of the protein composition of the invention, preferably an amount of about 0.0005% to about 0.2% w/v, more preferably an amount of about 0.001% to about 0.02% w/v of said protein composition.

For example, the pharmaceutical formula (or pharmaceutical composition) and/or the vaccine of the present invention comprises an amount of about 0.0001% to about 0.5% w/v of the protein composition of the present invention and an amount of about 0.001% to 50% w/v of a suitable adjuvant (preferably saponin, more preferably a saponin obtained from *Quillaja saponaria* such as QuilA®), with respect to the final volume of the composition.

For example, the pharmaceutical formula (or pharmaceutical composition) and/or the vaccine of the present invention comprises an amount of about 0.0005% to about 0.2% w/v of the protein composition of the present invention and an amount of about 0.001 to 50% w/v, preferably about 0.005% w/v, even more preferably about 0.01% w/v of a suitable adjuvant (preferably saponin, more preferably a saponin obtained from *Quillaja saponaria* such as QuilA®), with respect to the final volume of the composition.

For example, the pharmaceutical formula (or pharmaceutical composition) and/or the vaccine of the present invention comprises an amount of about 0.0005% to about 0.2% w/v of the protein composition of the present invention and an amount of about 0.005% w/v of a suitable adjuvant (preferably saponin, more preferably a saponin obtained from *Quillaja saponaria* such as QuilA®), with respect to the final volume of the composition.

For example, the pharmaceutical formula (or pharmaceutical composition) and/or the vaccine of the present invention comprises an amount of about 0.0005% to about 0.2% w/v of the protein composition of the present invention and an amount of about 0.01% w/v of a suitable adjuvant (preferably saponin, more preferably a saponin obtained from *Quillaja saponaria* such as QuilA®), with respect to the final volume of the composition.

For example, the pharmaceutical formula (or pharmaceutical composition) and/or the vaccine of the present invention comprises an amount of about 0.001% to about 0.02% w/v of the protein composition of the present invention and an amount of about 0.01 to 50% w/v, preferably about 0.005% w/v, even more preferably about 0.01% w/v of a suitable adjuvant (preferably saponin, more preferably a saponin obtained from *Quillaja saponaria* such as QuilA®), with respect to the final volume of the composition.

For example, the pharmaceutical formula (or pharmaceutical composition) and/or the vaccine of the present invention comprises an amount of about 0.001% to about 0.02% w/v of the protein composition of the present invention and an amount of about 0.005% w/v of a suitable adjuvant (preferably saponin, more preferably a saponin obtained from *Quillaja saponaria* such as QuilA®), with respect to the final volume of the composition.

For example, the pharmaceutical formula (or pharmaceutical composition) and/or the vaccine of the present invention comprises an amount of about 0.001% to about 0.02% w/v of the protein composition of the present invention and an amount of about 0.01% w/v of QuilA®, with respect to the final volume of the composition.

The protein composition and/or the pharmaceutical formula (or pharmaceutical composition) and/or the vaccine according to the present invention may preferably be used as a medicament. A "medicament" in the context of the present invention is understood as a compound or composition used to diagnose, cure, treat, or prevent a condition or disease.

The protein composition, pharmaceutical formula (or pharmaceutical composition) or vaccine of the invention can be used both in asymptomatic patients as well as in those who have already shown symptoms of the disease. The protein composition and/or the pharmaceutical formula (or pharmaceutical composition) and/or the vaccine according to the present invention may be administered before the infection, and/or after it.

Therapeutic Method

The protein composition and/or the pharmaceutical formula (or pharmaceutical composition) and/or the vaccine according to the present invention may be used in a method of therapeutic treatment (after infection or after the clinical manifestation of the disease caused by the infection) and/or prophylactic treatment (before infection or before the clinical manifestation of the disease caused by the infection) of infections caused by *Neospora* such as infections caused by *Neospora caninum* and/or *Neospora hughesi*, preferably, infections caused by *Neospora caninum*. Neosporosis is caused by infection with, e.g., the protozoa *Neospora caninum*.

The protein composition and/or the pharmaceutical formula (or pharmaceutical composition) and/or the vaccine according to the present invention may be used in a method of therapeutic treatment (after infection or after the clinical manifestation of the disease caused by the infection) and/or prophylactic treatment (before infection or before the clinical manifestation of the disease caused by the infection) of neosporosis.

The protein composition and/or the pharmaceutical formula (or pharmaceutical composition) and/or the vaccine according to the present invention may be administered to a mammal selected from the group consisting of canidaes and ungulates. The biological family canidae is a lineage of carnivores that includes dogs, wolves, foxes, jackals, and many other mammals. Ungulates are a diverse group of large mammals that includes horses, cattle, pigs, giraffes, camels, deer, and hippopotamuses (Euungulata). Nomenclature and placental mammal phylogeny can be found in Asher & Helgen, 2010, BMC Evolutionary Biology 10:102. The protein composition and/or the pharmaceutical composition and/or the vaccine according to the present invention may be administered to a mammal selected from the group consisting of domestic dog (*Canis lupus familiaris* or *Canis familiaris*), equidae (horse family), camelids (belonging to the family Camelidae), rumiants (including cattle, goats, sheep, giraffes, yaks, deer, antelope), sheep (*Ovis aries*) and cattle breed. Preferably, the protein composition and/or the pharmaceutical composition and/or the vaccine according to the present invention may be administered to a mammal selected from the group consisting of domestic dog and cattle, being cattle the most preferred one. Cattle belong to the subfamily Bovinae, and are commonly classified collectively as *Bos taurus*.

The protein composition and/or the pharmaceutical composition (or pharmaceutical formula) and/or the vaccine according to the present invention may be administered to a mammal in an amount of about 0.001-10 µg of the protein composition of the invention per kg of the individual (mammal) (µg/kg) to which the pharmaceutical formula (or pharmaceutical composition) and/or the vaccine is administrated, preferably an amount of about 0.01-1 µg/kg.

Preferably, the pharmaceutical composition (or pharmaceutical formula) and/or the vaccine according to the present invention may be administered to a mammal at least two times, with at least 14-21 days between each of the administrations, such as 14, 15, 16, 17, 18, 19, 20 and 21 days between each of the administrations. For example, one dose of the pharmaceutical formula (or pharmaceutical composition) and/or the vaccine according to the present invention may be administered to a mammal at day 0 and, after 21 days, another dose is administered to the mammal.

For example, a dose of 1 µg/kg may be administered to a mammal at day 0 and another dose of 1 µg/kg may be administrated to the same animal after 21 days.

For example, a dose of 0.1 µg/kg may be administered to a mammal at day 0 and another dose of 0.1 µg/kg may be administrated to the same animal after 21 days.

For example, a dose of 0.02 µg/kg may be administered to a mammal at day 0 and another dose of 0.02 µg/kg may be administrated to the same animal after 21 days.

Preferably, mammals are re-vaccinated (namely, the pharmaceutical formula or pharmaceutical composition and/or the vaccine according to the present invention is administered to the mammal) about one year after the first vaccination (namely, about one year after the first administration of the pharmaceutical composition and/or the vaccine according to the present invention).

For example, one animal (preferably selected from the group consisting of domestic dog and cattle, being cattle the most preferred one) is vaccinated at day 0 from year 0, at day 21 of year 0 and at a day comprised between day 0 and day 21 (such as day 0, 1, 2, 3, 4, 5, 6, 7, 8, 9, 10, 11, 12, 13, 14, 15, 16, 17, 18, 19, 20 or 21) of year 1. For example, one animal (preferably selected from the group consisting of domestic dog and cattle, being cattle the most preferred one) is vaccinated at day 0 from year 0, at day 21 of year 0 and at day 0 of year 1. For example, one animal (preferably selected from the group consisting of domestic dog and cattle, being cattle the most preferred one) is vaccinated at day 0 from year 0, at day 21 of year 0 and at day 21 of year 1.

According to the present invention, the term "vaccinate" may be understood as to administer the pharmaceutical formula (or pharmaceutical composition) and/or vaccine and/or protein composition of the present invention to a mammal.

The pharmaceutical formula (or pharmaceutical composition) and/or the vaccine according to the present invention may be administered orally, intranasally, intradermally, subcutaneously, by aerosol, intramuscularly, wing web and eye-drop administration, preferably subcutaneously. For example, the pharmaceutical formula (or pharmaceutical composition) and/or the vaccine according to the present invention may be administered through the mucosa of the mammal (preferably selected from the group consisting of domestic dog and cattle, being cattle the most preferred one). For example, the pharmaceutical composition and/or the vaccine according to the present invention may be administered subcutaneously to the mammal (preferably selected from the group consisting of domestic dog and cattle, being cattle the most preferred one).

In the context of the present invention, the expression "therapeutically effective amount" refers to the amount of protein composition, pharmaceutical formula (or pharmaceutical composition) or vaccine of the invention that allow producing the desired effect. The pharmaceutically acceptable adjuvants and carriers that can be used in the pharmaceutical formulas (or pharmaceutical compositions) and/or vaccines are carriers known by persons skilled in the art. The compositions provided by this invention can be facilitated through any administration route, for which purpose said composition will be formulated in the suitable dosage form and with the excipients that are pharmacologically acceptable for the chosen administration route.

For purposes of the present invention, the term "effective dose" refers to the minimum dose capable of producing the desired effect, whether the reversion of a disease state, or inducing a specific immune response, etc.

Unless otherwise defined, all technical and scientific terms used herein have the meaning commonly understood by one skilled in the art to which this invention belongs.

EXAMPLES

1. Production of the "Enriched Antigen Extract" (EAE).

1.1 Materials & Methods: Culture of the Parasite and Production of the "Enriched Antigen Extract" (EAE)

The enriched antigen extract (EAE) or protein composition according to the present invention was prepared from tachyzoites of the Nc-Spain 7 isolate of *N. caninum* (deposited on 20 Sep. 2005, by Prof. Luis Miguel Ortega Mora, Grupo de salud veterinaria y zoonosis, Departamento de sanidad animal—Facultad de veterinaria, Universidad Complutense de Madrid, Avenida Puerta de Hierron S/N, Ciudad Universitaria, 28040, Madrid, Spain, according to the provisions of the Budapest Treaty on the International Recognition of the Deposit of Microorganisms for the Purposes of Patent Procedure, in the Culture Collection of Algae and Protozoa (CCAP) located in the Dunstaffnage Marine Laboratory, Dunbeg, OBAN, Argyll PA37 1QA, United Kingdom, with accession number CCAP 2051/1, the identification reference given by the depositor being "*Neospora caninum* Nc-Spain 7") maintained in MARC-145 monkey kidney cell monolayers (USDA, ARS, Clay Center, Ne, USA) by successive passages at 3-4 day intervals following standard procedures (Regidor-Cerrillo et al., 2010. Vet Res. 41: 52). For each culture passage, tachyzoites were recovered from cultures by cell scraping, passaged by 25G needle and inoculated onto a fresh MARC-145 monolayer in Dulbecco's Minimum Essential Medium (DMEM) supplemented with 1% (v/v) antibiotic-antimycotic solution (Gibco BRL, Paisley, UK) and 2% (v/v) foetal bovine serum and incubated at 37° C. in 5% $CO_2$.

The tachyzoites for the EAE were obtained from a cellular culture maintained in identical conditions described above. The tachyzoites for the extracts were recovered from the culture after a lack of cellular lysis in 80% of the infected cells and, preferably, in 90-100% of the infected cells, confirmed using an inverted optical microscope of 400×, where the number of lysis plates caused by the liberation of the parasite and the number of cells with vacuoles originated from parasites in a minimum of five different fields was microscopically examined. The cell layer was mechanically detached from flasks using a cell scraper, recovered by centrifugation at 4° C. (1350×g, 15 min) and re-suspended in a phosphate buffer solution (PBS, pH 7.4). To purify the tachyzoites, the suspension was passed through a 25 G needle (for releasing tachyzoites) and afterwards, the suspension was passed through Sephadex G-25 PD10 chromatographic columns (GE Healthcare) for separating the tachyzoites from cell debris, as described by Hemphill, 1996 (Hemphill, 1996. Infect. Immun. 64, 4279-4287). The number of total eluted and viable purified tachyzoites was determined in the eluent of the columns by counting in the Neubauer chamber. All batches of purified tachyzoites showed a viability >90%. Purified tachyzoites were centrifuged (1350×g, 15 min, 4° C.) and the supernatant was discarded. Tachyzoites were kept at −80° C. until they were processed for the production of the EAE.

For the production of the EAE, a total of $10^8$ purified tachyzoites kept at −80° C. were re-suspended in 600 μl of PBS with 0.5% (v/v) protease inhibitor (protease inhibitor cocktail, Sigma-Aldrich) (the recommended use of the protease inhibitor employed is at a concentration of 1 ml for each 20 g of *E. coli*. Taking this into account, and estimating that $10^8$ tachyzoites are approximately 5 mg, the employed concentration was of about 0.25 μl of inhibitor per $10^8$ tachyzoites). Once re-suspended, 300 μl of 60% sucrose (w/v in PBS) were added to the suspension to obtain a final concentration of 20% (w/v) sucrose in the mixture and, then, the parasite was recovered through centrifugation (10.000× g, 60 min, 4° C.). The precipitate (pellet) obtained was re-suspended in 0.1 ml of 1% Triton X-100 solution (v/v in ultrapure water) supplemented with 0.5% of the same protease inhibitor for the solubilisation of the components. The precipitate was disaggregated by passing it through a 25 G needle, and it was kept in constant agitation during 18 h at 4° C. in order to complete its homogenization. The protein concentration in the EAE was quantified using the Bradford method and it was aliquoted and kept at −80° C. until further use in other experiments.

1.2 Results: Purification Yield and Obtention of the EAE

The mean percentage of recovery after tachyzoite purification by chromatographic column was of 66% according to the data obtained in 6 independent experiments. With regard to the average production yield of the EAE, expressed as the amount of protein produced from $10^8$ tachyzoites, this was of 140 µg/$10^8$ tachyzoites according to the results obtained from 5 different extraction experiments of different tachyzoites batches (Table 1).

TABLE 1

Production yield of the extract from purified tachyzoites in five different batches of production.

| Experiment | Purified Tachyzoites ($10^8$) | Protein concentration (mg/ml; Bradford) | EAE amount (V) (µl) | TOTAL PROTEIN (mg) | PROTEIN YIELD (µg/$10^8$ tachyzoites) |
|---|---|---|---|---|---|
| 1 | 12.1 | 2 | 600 | 1.2 | 100 |
| 2 | 29 | 1.3 | 2400 | 3.1 | 107 |
| 3 | 96 | 1.8 | 9000 | 16.2 | 168 |
| 4 | 7.6 | 1.1 | 760 | 0.836 | 110 |
| 5 | 83 | 2.1 | 8300 | 17.9 | 216 |
| Mean | | 1.66 | | | 140 |

2. Characterization of the EAE: Protein Pattern in SDS-PAGE Coomassie Gels

As part of the characterization of the EAE, its protein composition was compared to the composition of a soluble extract of tachyzoites and compared to the composition of the whole tachyzoite used in other formulations (whole tachyzoite sample or "WTS"). Variations in the composition were analyzed through the study of the protein pattern in SDS-PAGE gels stained with Coomassie. Variation in protein band pattern between EAE and the whole tachyzoite sample and soluble tachyzoite extract were observed, showing differences in protein abundance and/or protein composition among the different extracts (FIG. 1).

2.1 Materials and Methods: Preparation of Extracts for SDS-PAGE Gels, Electrophoresis Conditions and Coomassie Staining For the production of the "soluble extract", a total of $2 \times 10^9$ tachyzoites, recovered from cell cultures, purified and kept at −80° C. using identical conditions that for EAE described in Example 1, were re-suspended in 4-5 ml of a Tris base solution 10 mM pH 7 supplemented with a solution of 0.5% protease inhibitor (v/v) (protease inhibitor cocktail, Sigma-Aldrich). The suspension was kept at 4° C. and subjected to sonication cycles (Branson Digital Sonifier) of 15-20% of wideness, until the tachyzoites were completely disrupted by confirmation under microscopic examination. The suspension was centrifuged (10.000×g, 30 min, 4° C.), the supernatant recovered as the soluble extract, and kept at −80° C. until it was used. The protein concentration of the soluble extract was determined by Bradford method.

The amount of 50 µg of protein of the EAE and soluble extracts were mixed with the required amount of protein lysis buffer 2× (sodium dodecyl sulfate (SDS) 4%, glycerol 10%, 60 mM of Tris-HCl (pH 6.8), 100 mM of dithiothreitol (DTT), and 0.048% of bromophenol blue), boiled during 5 min and run by one dimensional electrophoresis (1-DE) in SDS-PAGE polyacrylamide gels. Similarly, a precipitate of N. caninum tachyzoites purified by column and kept at −80° C. for EAE was re-suspended in lysis buffer 1× for "whole tachyzoite sample" (also referred to as "WTS" in the present specification), and a volume comprising $3 \times 10^7$ tachyzoites was resolved into SDS-PAGE gels together with the EAE and soluble tachyzoite extract. All samples were run in parallel with the Precision Plus Protein Standards Kaleidoscope marker (Bio-Rad) in order to determine the relative molecular weight of the protein bands. The different samples were resolved at 100 V (constant) during 6 h in a bis/acrylamide stacking gel at 4% (pH 6.8), followed by an acrylamide/bisacrylamide separating gel at 10%, in the presence of Tris-Glycine-SDS electrophoresis buffer and using a PROTEAN II System (Bio-Rad, California, USA).

After electrophoresis, the acrylamide gels were stained in a Coomassie colloidal-ethanol-acetic solution and aluminium salts during 3 h (Kang et al., 2002, Bull. Korean Chem. Soc. 11, 1511-1512), and afterwards they were rinsed in an ethanol-acetic solution until the band pattern for each sample was visible in the gel.

2.2 Results: Protein Pattern of the EAE in Coomassie Gels

The protein pattern of the different extracts shown by Coomassie stained SDS-PAGE gels is shown in FIG. 1.

A visual comparison of the pattern of the stained bands in each of the samples allows for the detection of bands which intensity was drastically increased or decreased in the patterns of the soluble extract and WTS in comparison with the pattern of the EAE, evaluated in three replicates from different production batches. Differences in the protein profiles were detected in six main regions of the Coomasie gel (marked as boxes and identified by numbers in FIG. 1) which are located on the average of 80 kDa and 70 kDa (Box 1, FIG. 1); average of 60 kDa and 50 kDa (Box 2, FIG. 1); average of 45 kDa and 40 kDa (Box 3, FIG. 1); average of 37 and 32 kDa (Box 4, FIG. 1); average of 26 kDa and 22 kDa (Box 5, FIG. 1); and average 20 kDa and 13 kDa (Box 6, FIG. 1). Different bands were increased in abundance in the soluble extract and whole tachyzoite sample in comparison with the EAE (e.g. Box 5 in FIG. 1), as well as in the EAE compared to the other samples (e.g, Box 3 in FIG. 1). These findings demonstrated marked variations on the abundance/composition of the EAE in comparison with the soluble extract and WTS.

3. Characterization of the EAE: Antigen Pattern Using 1-DE Western Blotting

The characterization of the EAE compared to the soluble extract and whole tachyzoite sample (WTS) were carried out also through the analysis of the pattern of the antigens recognised on each of the extracts with the sera of naturally infected and experimentally N. caninum infected animals.

3.1 Materials and Methods: Western Blotting

The characterization of the EAE extract was carried out using Western Blotting (WB) based on 1-DE polyacrylamide SDS-PAGE gels and transfer to a nitrocellulose membrane afterwards. To do so, an amount of 20 µg of protein of the EAE (two replicates) and soluble extract was mixed with the required protein lysis buffer volume and subjected to electrophoresis in polyacrylamide SDS-PAGE gels, as described in Example 2. Similarly, a precipitate of purified and N. caninum tachyzoites kept at −80° C. was resuspended in lysis buffer and the volume containing $1.4 \times 10^7$ tachyzoites was resolved in SDS-PAGE gels, together with the extracts (WTS). In order to estimate the migration pattern of the different proteins detected afterwards, the marker Precision Plus Protein Standards Kaleidoscope (Bio-Rad) was also included. After electrophoresis, the proteins were transferred to a nicrocellulose membrane of 0.22 µm at 50 mA during 18 h using the Trans-Blot Cell (Bio-Rad) system. After the protein transfer, membranes were treated with a blocking solution in TBS buffer (5% skimmed milk in TBS-Tween 20 0.05%) and afterwards incubated with the following sera:

1) Sera of pregnant mice inoculated with $2 \times 10^6$ tachyzoites of the N. caninum isolate Nc-Liverpool (Nc-Liv) (Barber et al., 1995, Parasitology 111, 563-568). in the seventh day of pregnancy and recovered in the thirtieth day after birth of the offspring (day 45 after inoculation) in a dilution 1:50 as the primary antibody and, as a secondary antibody, a murine anti-IgG antibody conjugated with peroxidase in a dilution 1:500 (Sigma-Aldrich). The mice serum used in the test was the result of the mixture of the same volumes of sera from five infected mice.

2) Bovine sera of natural and experimental infections in a 1:20 dilution as primary antibody and bovine anti-IgG conjugated with peroxidase as the secondary antibody (Life Technologies) in a 1:200 dilution.

The sera of the experimental infection used in the test was the result of the mixture of 5 heifers inoculated with $10^7$ tachyzoites of the N. caninum isolate Nc-Spain 7 in the seventieth pregnancy day and recovered in the twenty-eighth day post-inoculation. Sera of a natural infection was the result of the mixture of same volumes of three sera obtained from animals naturally infected and previously evaluated serologically as positives by WB.

After incubation with the second antibody, the antigen-antibody complexes formed were detected by chromogenic reaction with 4-Chloro-1-naphthol (BioRad).

3.2 Results: Antigen Pattern of EAE Extract.

Figure 2:
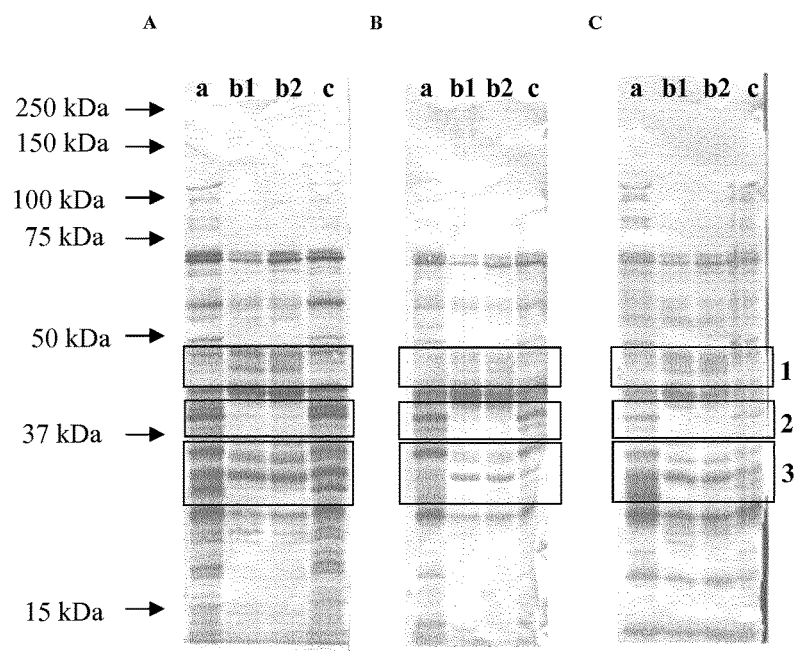
FIG. 2: Pattern of antigens by western blotting of the soluble extract (a), EAE (2 replicates; b1 and b2), and WTS (c) with sera from experimentally infected mice (A), *N. caninum* experimentally infected bovine (B) and *N. caninum* naturally infected bovine (C). Arrows highlight molecular weight standards with molecular masses in kDa. Boxes delimit regions of high differentiation in the antigen pattern between the EAE, the soluble extract and the WTS: box 1 delimits the 48 kDa and 43 kDa region; box 2, the 42 kDa and 37 kDa region and the box 3, the 37 kDa and 30 kDa region.

The antigen pattern for each of the extracts and evaluated sera is shown in FIG. 2.

The majority of the antigens recognized by the experimental and natural infection sera from bovine and from mice sera in the three extracts were shared showing all of the sera very similar antigenic patterns. However, clear differences were observed when comparing the antigenic pattern recognized in the EAE extract and the antigenic pattern recognized in the soluble and whole tachyzoite extracts, which highlight the differences shown in the antigen composition and/or abundance of those extracts.

The highest variations were observed in three main regions of the WB (marked as boxes and identified by numbers in FIG. 2). New antigens in the fractions belonging to the 48 kDa and 43 kDa (Box 1 in FIG. 2), as well as 37 kDa and 30 kDa of EAE replicates (Box 3 in FIG. 2) were recognized, whereas some of the antigens of the soluble and whole tachyzoite extracts in the fraction between 42 kDa and 37 kDa were not recognized or very weakly recognized in the EAE extract by the bovine and mice sera (Box 2 in FIG. 2).

4. Composition of the Enriched Antigen Extract (EAE) Using Quantitative Label-Free Comparative Proteomics Analysis In this example, we proceeded to identify the protein composition of the EAE in comparison with the whole tachyzoite extract (WTE) as the reference sample using quantitative label free comparative proteomics analysis. WTE samples for proteomic analysis were prepared by direct resuspension of frozen tachyzoites in the surfactant Triton-X 100 without previous treatment of tachyzoites with the sucrose hiperosmotic solution (described in detail in 4.1.1. Neospora caninum cultures, tachyzoite production for EAE and WTE, and EAE and WTE production). Quantitative label-free comparative proteomics analysis after liquid chromatography-tandem mass spectrometry (LC-MS/MS) was employed for the identification of the proteins included in the EAE and the WTE and their relative quantification in both extracts. Quantitative analysis was carried out by comparison of three samples of EAE with three samples of WTE obtained in different batches of production (biological replicates) that were analyzed by duplicate using LC-MS/MS (technical replicates). The relative quantity of identified proteins describes and defines the composition of the extract.

4.1 Material and Methods.

4.1.1. Neospora caninum Cultures, Tachyzoite Production for EAE and WTE, and EAE and WTE Production Tachyzoites of the Nc-Spain 7 isolate of N. caninum (deposited on 20 Sep. 2005, by Prof. Luis Miguel Ortega Mora, Grupo de salud veterinaria y zoonosis, Departamento de sanidad animal—Facultad de veterinaria, Universidad Complutense de Madrid, Avenida Puerta de Hierron S/N, Ciudad Universitaria, 28040, Madrid, according to the provisions of the Budapest Treaty on the International Recognition of the Deposit of Microorganisms for the Purposes of Patent Procedure, in the Culture Collection of Algae and Protozoa (CCAP) located in the Dunstaffnage Marine Laboratory, Dunbeg, OBAN, Argyll PA37 1QA, United Kingdom, with access accession number CCAP 2051/1) were maintained in MARC-145 monkey kidney cell monolayers (USDA, ARS, Clay Center, Ne, USA) by successive passages at 3-4 day intervals following standard procedures (Regidor-Cerrillo et al., 2010. Vet Res. 41: 52) as described above in the Example 1 (the skilled person would understand that the tachyzoites may equally be maintained in any other suitable cell line).

Tachyzoites used in EAE and WTE production were recovered from cultures, purified and maintained at −80° C. using identical conditions described in Example 1. EAE was equally produced as described in Example 1. Protein concentration in the EAE was measured by the Bradford method using BSA as the standard. Protein concentration varied from 1.8 to 2 mg/ml among the samples-batches of production (replicates) included in the study.

WTE samples for proteomic analysis were prepared by direct resuspension of a pellet of $10^8$ frozen tachyzoites in 100 µl of 1% Triton-X 100 (v/v) with 0.5% protease inhibitor cocktail (Sigma-Aldrich) and shaking overnight at 4° C. Protein concentration determined by Bradford in WTE samples varied from 4.1 to 4.7 mg/ml among three replicates.

4.1.2. Sample Preparation for LC-MS/MS Experiments

EAE and WTE samples for proteomics were precipitated using the chloroform/methanol protocol described by Wessel and Flugge, 1984 (Wessel and Flugge, 1984, Anal. Biochem. 138(1): 141-143). Then, protein pellets were resuspended in 150 µl of 8M urea and quantified by the colorimetric technique RC/DC Protein Assay (BioRad, Hercules, Calif., USA). Then, the amount of 20 µg of protein of each sample (biological replicate) was in-solution trypsin digested. Briefly, samples were reduced with 10 mM DTT at 37° C. for 1 h and alkylated in the dark for 1 h with 55 mM iodoacetamide. Then, samples were diluted with 50 mM ammonium bicarbonate until reaching a concentration of 2M urea in the final solution (pH 8.5), and samples were digested overnight with a 1/20 (w/w) of Recombinant Sequencing Grade Trypsin (Roche Molecular Biochemicals, Mannheim, Germany). The resulting peptides were desalted and concentrated with reverse phase (RP) chromatography using Bond Elut OMIX C18 tips (Agilent technologies, Santa Clara, Calif., USA) and the peptides were eluted with 50% acetonitrile (ACN)/0.1% trifluoroacetic acid (TFA). Finally, the samples were freeze-dried in a vacuum centrifuge and resuspended in 0.1% formic acid (FA)/2% ACN before the Nano LC-MS/MS analysis. The supernatants were stored at −20° C. until analysis.

4.1.3. Liquid Chromatography Tandem Mass Spectrometry (LC-MS/MS)

Three EAE and three WTE samples were firstly analysed in duplicate (12 replicates) by reverse phase (RP) and LC-MS/MS analysis. Peptide identification was performed using an Easy-nanoLC II system (Proxeon Biosystems, Odense, Denmark) coupled to an ion trap LTQ-Orbitrap-Velos-Pro mass spectrometer (Thermo Fisher Scientific, Dreieich, Germany). The digested peptide mixtures were concentrated (on-line) by RP chromatography using a 0.1 mm×20 mm C18 RP precolumn (Thermo Scientific). Then, peptides were separated using a 0.075 mm×150 mm analytical C18 RP column (Thermo Scientific) and eluted using a 180 min gradient from 5% solvent B to 40% solvent B in solvent A (solvent A contained 0.1% AF, 2% ACN in water; solvent B contained 0.1% AF, 80% ACN in water) operating at 0.3 µl/min.

Peptides eluting from the column were electrosprayed directly into the mass spectrometer (on-line). Electrospray ionization (ESI) was performed using a Nano-bore emitters Stainless Steel ID 30 µm (Proxeon Biosystems, Odense, Denmark). The mass spectrometer was operated in a data-dependent mode to switch between MS and MS/MS acquisition. Survey full scans MS spectra were acquired in the Orbitrap mass analyzer at a resolution of 30,000. Peptides were detected in survey scans from 400 to 1600 amu, (1 µscan) followed by fifteen data dependent MS/MS scans (Top 15), using an isolation width of 2 mass-to-charge ratio units, normalized collision energy of 35%, and dynamic exclusion applied during 30 second periods.

4.1.4. Peptide Identification by Mascot Database Searches

Peptide identification from first raw data obtained from LTQ-Orbitrap-Velos-Pro mass spectrometer Orbitrap was carried out using licensed version of search engine MASCOT 2.3.0 (Matrix Science, London, UK). Tandem MS/MS data were searched against home-made database with predicted sequences of the N. caninum Nc-Liv isolate downloaded from ToxoDB database (ToxoDB-13.0_Ncaninum-LIV_AnnotatedProteins; 7122 sequences; Date of download 9 Feb. 2015) (Gajria et al., 2008. Nucleic Acids Res. 36; Database issue: D553-556). This was a forward and reversed version of the N. caninum Nc-Liv isolate sequence database (ToxoDB-13.0_NcaninumLIV_AnnotatedProteins, forward and reversed protein sequences from ToxoDB database). The following constraints were used for the searches: tryptic cleavage after Arg and Lys, up to two missed cleavage sites allowed, and tolerances of 20 ppm for precursor ions and 0.6 Da for MS/MS fragment ions and the searches were performed allowing optional Methionine oxidation and fixed carbamidomethylation of Cysteine. Search against decoy database (Mascot integrated decoy approach) was used to FDR calculation. MASCOT percolator filter were applied to MASCOT results (Matrix Science). The acceptances criteria for proteins identification were a FDR<1% and, at least, one peptide identified with high confidence (CI>95%).

4.1.5. Protein Relative Quantification

For subsequent relative quantification of Neospora caninum proteins in two different conditions of extract production (WTE vs EAE) the raw profile data files (.raw) were directly imported into Progenesis LC-MS QI v4.1 for proteomics (Nonlinear Dynamics/A Waters company, Newcastle upon Tyne, UK) and broadly analysed for identification of differentially abundant proteins between EAE and WTE. Imported runs from biological and technical replicates (12 runs) were used for chromatography alignment (retention time against m/z values) and matched to the reference run automatically identified by the Progenesis software. Peak picking was carried out with the automatic sensitivity method (using Progenesis software default settings) using information from all of the runs. After review peak alignment all runs showed a score with the reference run >75%. By filtering only peaks with a charge state between 2 and 4 were selected. Then, all detected peptide features were normalized against the reference run by Progenesis software by means of the calculation of the normalization factor for each run.

"Between-subject" design tool from Progenesis software was used as experimental design on the analysis for comparison of two conditions: WTE vs EAE. MS/MS spectral data from selected peptide features that showed difference in abundance between groups (ANOVA p-value <0.05) were transformed to MGF files with Progenesis software and exported for peptide/protein identification to Mascot search engine, using the search parameters and database described above in the Example 4.1.4, following acceptance criteria: FDR<1%, peptides with individual ion scores >13, and p<0.05. Mascot search results were imported into Progenesis as XML files and analyzed for protein quantification according to the following criteria: (1) for each identified protein (FDR<1%), (2) the number of reported peptides was determined by counting unique peptide sequences (CI>95%) and only proteins reported by two or more peptides with a p-value <0.05 were quantified, and (3) protein quantitation was done with only the non-conflicting peptide features. Protein abundance was calculated from the sum of all unique normalized peptide ion abundances for one specific protein in each run. Finally, relative protein abundance (fold change) and reliability of the measured differences (ANOVA p-value) were calculated between each group, WTE vs EAE samples, using the summed peptide ion abundances.

4.1.6. In Silico Analysis of Deferentially Abundant Identified Proteins

Subcellular localisation of the differentially abundant proteins in EAE and WTE was analyzed. Each individual identified protein was submitted to the motif prediction algorithms SignalP (Bendtsen et al., 2004, J. Mol. Biol. 340:783-795) and TMHMM (Krogh et al., 2001, J. Mol. Biol. 305:567-580) for prediction of signal peptides and transmembrane protein topology, respectively. Furthermore, protein subcellular localization information was first assigned according to gene descriptions and Gene Ontology (GO) cellular component prediction downloaded from ToxoDB (Gajria et al., 2008. Nucleic Acids Res. 36; Database issue: D553-556). As an alternative approach for non-classified protein, we identified the protozoan OrthoMCL (Li et al., 2003. Genome Res. 13, 2178-2189) ortholog clusters containing identified proteins and GO classification for the closely related *Toxoplasma gondii* parasite was considered for sub-cellular localization for *N. caninum* identified proteins.

Categories for sub-cellular localizations comprise common eukaryotic cell structures and organelles as cellular membrane, cytoplasm, nucleous, mitochondria, ribosome, endoplasmic reticulum-Golgi, cytoskeleto and extracellular locations, in addition to specialized structures and secretion organelles for Apicomplexa as apicoplast, inner membrane complex, SRS-surface associated membrane proteins, microneme, rhoptrie and dense granules.

4.2 Results.

4.2.1. Raw LC-MS Data Analysis

First protein composition analysis of EAE was carried out using raw LC-MS/MS data obtained directly from mass spectrometer for protein identification as described in Example 4.1.4. Table 2 shows the number of identified proteins for each sample and technical replicate from raw data of acquired MS/MS scans, according to the acceptances criteria of a FDR<1% and, at least, one peptide identified with high confidence (CI>95%). The number of identified proteins varied from 946 to 1145 without marked differences across the samples/replicates (Table 2).

TABLE 2

Number of identified MS/MS spectra and identified proteins for each sample and technical replicate.

| Sample; (biological triplicates) | Technical duplicates | No MS/MS spectra | No of identified proteins |
|---|---|---|---|
| EAE1 | EAE1_A | 42373 | 1145 |
|  | EAE1_B | 41647 | 1094 |
| EAE2 | EAE2_A | 35566 | 946 |
|  | EAE2_B | 36028 | 932 |
| EAE3 | EAE3_A | 40976 | 1019 |
|  | EAE3_B | 40148 | 986 |
| WTE1 | WT1_A | 36109 | 973 |
|  | WT1_B | 38898 | 1048 |
| WTE2 | WT2_A | 37826 | 1095 |
|  | WT2_B | 37766 | 1052 |
| WTE3 | WT3_A | 37540 | 1022 |
|  | WT3_B | 38240 | 1003 |

The list of the identified proteins detected in all three biological replicates of the EAE is shown in Table 3.

TABLE 3

List of identified protein in EAE by LC-MS/MS analysis.

| Accession number[1] | Description[2] |
|---|---|
| NCLIV_070010 | hypothetical protein, conserved |
| NCLIV_019110 | HSP90-like protein, related |
| NCLIV_042820 | cDNA FLJ58099, highly similar to *Homo sapiens* clathrin, heavy polypeptide-like 1 (CLTCL1), transcript variant 1, mRNA, related |
| NCLIV_048590 | unspecified product |
| NCLIV_049900 | hypothetical protein |
| NCLIV_055360 | unspecified product |
| NCLIV_055490 | Heat shock protein 70 (Precursor), related |
| NCLIV_064620 | unspecified product |
| NCLIV_033950 | Heat shock protein 70, related |
| NCLIV_011410 | protein disulfide isomerase |
| NCLIV_046170 | Heat Shock Protein 70, ER lumen, related |
| NCLIV_040880 | hsp90, related |
| NCLIV_059600 | putative KH domain-containing protein |
| NCLIV_014060 | putative lysophospholipase |
| NCLIV_001670 | elongation factor 1-alpha, related |
| NCLIV_066840 | hypothetical protein |
| NCLIV_066020 | hypothetical protein |
| NCLIV_001970 | unspecified product |
| NCLIV_003050 | putative myosin heavy chain |
| NCLIV_046050 | hypothetical protein |
| NCLIV_020840 | hypothetical protein |
| NCLIV_031550 | unspecified product |
| NCLIV_019770 | hypothetical protein |
| NCLIV_007260 | putative p97 protein |
| NCLIV_015430 | hypothetical protein |
| NCLIV_067140 | Myosin, related |
| NCLIV_039100 | hypothetical protein |
| NCLIV_002940 | putative microneme protein MIC4 |
| NCLIV_045800 | 60S ribosomal protein L3, related |
| NCLIV_047860 | hypothetical protein |
| NCLIV_031780 | hypothetical protein |
| NCLIV_046260 | Iron regulatory protein-like protein, related |
| NCLIV_003440 | actin, related |
| NCLIV_015440 | hypothetical protein |
| NCLIV_032660 | hypothetical protein |
| NCLIV_005150 | hypothetical protein |
| NCLIV_058890 | tubulin alpha chain |
| NCLIV_017370 | putative CAMP-dependent protein kinase regulatory subunit |
| NCLIV_025670 | ATP synthase subunit beta, related |
| NCLIV_007800 | unspecified product |
| NCLIV_034460 | hypothetical protein |
| NCLIV_043270 | putative microneme protein MIC1 |
| NCLIV_033230 | SRS domain-containing protein |
| NCLIV_065210 | KLLA0F09449p, related |
| NCLIV_010600 | putative microneme protein MIC3 |
| NCLIV_060730 | unspecified product |

TABLE 3-continued

List of identified protein in EAE by LC-MS/MS analysis.

| Accession number[1] | Description[2] |
|---|---|
| NCLIV_025240 | putative Gbp1p protein |
| NCLIV_038360 | tsp1 domain-containing protein TSP12 (Precursor), related |
| NCLIV_016800 | putative TCP-1/cpn60 chaperonin family protein |
| NCLIV_068400 | unspecified product |
| NCLIV_068460 | unspecified product |
| NCLIV_050370 | unspecified product |
| NCLIV_053580 | 50S ribosomal protein L4P, related |
| NCLIV_024820 | 14-3-3 protein homolog |
| NCLIV_0230 | eukaryotic translation initiation factor 3 subunit 10 |
| NCLIV_001520 | eukaryotic translation initiation factor 3 subunit C, related |
| NCLIV_039400 | hypothetical protein |
| NCLIV_048570 | conserved hypothetical protein |
| NCLIV_025920 | hypothetical protein |
| NCLIV_001300 | putative calmodulin |
| NCLIV_068920 | SRS domain-containing protein |
| NCLIV_036700 | putative M16 family peptidase |
| NCLIV_002520 | hypothetical protein |
| NCLIV_045585 | conserved hypothetical protein |
| NCLIV_061170 | hypothetical protein |
| NCLIV_025190 | LOC549444 protein, related |
| NCLIV_011980 | calmodulin-like domain protein kinase isoenzyme gamma, related |
| NCLIV_034130 | hypothetical protein |
| NCLIV_012920 | unspecified product |
| NCLIV_032430 | conserved hypothetical protein |
| NCLIV_021050 | unspecified product |
| NCLIV_058440 | Os02g0824100 protein, related |
| NCLIV_030050 | unspecified product |
| NCLIV_008850 | conserved hypothetical protein |
| NCLIV_000010 | putative heat shock protein 90 |
| NCLIV_004190 | putative thioredoxin |
| NCLIV_020220 | putative elongation factor 2 |
| NCLIV_061160 | putative acid phosphatase |
| NCLIV_017500 | hypothetical protein |
| NCLIV_015380 | conserved hypothetical protein |
| NCLIV_050590 | GL11864, related |
| NCLIV_024740 | Myosin, heavy polypeptide 1, skeletal muscle, adult, related |
| NCLIV_0341 | eukaryotic translation initiation factor 3 subunit 6 interacting protein |
| NCLIV_031670 | conserved hypothetical protein |
| NCLIV_030940 | hypothetical protein |
| NCLIV_065470 | hypothetical protein |
| NCLIV_015920 | Histone H4, related |
| NCLIV_010730 | srs domain-containing protein |
| NCLIV_033690 | hypothetical protein |
| NCLIV_068850 | unspecified product |
| NCLIV_032390 | conserved hypothetical protein |
| NCLIV_021080 | hypothetical protein |
| NCLIV_015880 | hypothetical protein |
| NCLIV_048460 | putative thioredoxin |
| NCLIV_010320 | putative dihydrolipoamide branched chain transacylase, E2 subunit |
| NCLIV_042410 | putative sortilin |
| NCLIV_015410 | hypothetical protein |
| NCLIV_037190 | putative glyceraldehyde-3-phosphate dehydrogenase |
| NCLIV_060820 | V-type ATP synthase beta chain, related |
| NCLIV_000390 | conserved hypothetical protein |
| NCLIV_050470 | hypothetical protein |
| NCLIV_012120 | hypothetical protein |
| NCLIV_041740 | conserved hypothetical protein |
| NCLIV_016850 | AT3G15980 protein, related |
| NCLIV_031970 | hypothetical protein |
| NCLIV_041180 | 60s ribosomal protein L10, related |
| NCLIV_030420 | Rcn2-prov protein, related |
| NCLIV_010720 | srs domain-containing protein |
| NCLIV_036830 | conserved hypothetical protein |
| NCLIV_045460 | Mitochondrial presequence protease (Precursor), related |
| NCLIV_024880 | 30S ribosomal protein S9P, related |
| NCLIV_062720 | hypothetical protein |
| NCLIV_025160 | hypothetical protein |
| NCLIV_054140 | putative adenylyl cyclase associated protein |
| NCLIV_052390 | hypothetical protein |
| NCLIV_067010 | Mitochondrial phosphate carrier protein, related |
| NCLIV_066310 | DEAD-box ATP-dependent RNA helicase 34, related |
| NCLIV_015210 | putative ATP-dependent helicase, putaive |
| NCLIV_022220 | hypothetical protein |
| NCLIV_061830 | 60S acidic ribosomal protein P0 |
| NCLIV_043330 | hypothetical protein |
| NCLIV_024630 | putative porin |

TABLE 3-continued

List of identified protein in EAE by LC-MS/MS analysis.

| Accession number[1] | Description[2] |
|---|---|
| NCLIV_032290 | SSU ribosomal protein S3P, related |
| NCLIV_056430 | conserved hypothetical protein |
| NCLIV_018530 | conserved hypothetical protein |
| NCLIV_065090 | conserved hypothetical protein |
| NCLIV_049050 | RNA helicase-related protein required for pre-mRNA splicing, related |
| NCLIV_047660 | hypothetical protein |
| NCLIV_052350 | conserved hypothetical protein |
| NCLIV_064950 | hypothetical protein |
| NCLIV_029990 | putative vacuolar ATP synthase catalytic subunit A |
| NCLIV_050680 | hypothetical protein |
| NCLIV_038400 | methionine aminopeptidase, related |
| NCLIV_020250 | hypothetical protein |
| NCLIV_067180 | Glucose-6-phosphate 1-dehydrogenase, related |
| NCLIV_023090 | hypothetical protein |
| NCLIV_045010 | hypothetical protein |
| NCLIV_032270 | conserved hypothetical protein |
| NCLIV_047810 | hypothetical protein |
| NCLIV_024420 | hypothetical protein |
| NCLIV_044000 | hypothetical protein |
| NCLIV_003310 | hypothetical protein |
| NCLIV_062520 | 3-ketoacyl-(Acyl-carrier-protein) reductase, related |
| NCLIV_010740 | putative kelch motif domain-containing protein |
| NCLIV_069590 | hypothetical protein |
| NCLIV_044200 | hypothetical protein |
| NCLIV_031770 | putative membrane skeletal protein IMC1 |
| NCLIV_024870 | hypothetical protein |
| NCLIV_028680 | putative apical membrane antigen 1 |
| NCLIV_067350 | putative P-type Ca(2+)-ATPase |
| NCLIV_055720 | hypothetical protein |
| NCLIV_032330 | Malate dehydrogenase (NAD) (Precursor), related |
| NCLIV_018420 | unspecified product |
| NCLIV_037520 | conserved hypothetical protein |
| NCLIV_055760 | conserved hypothetical protein |
| NCLIV_036400 | unspecified product |
| NCLIV_007770 | putative Rhoptry kinase family protein, truncated (incomplete catalytic triad) |
| NCLIV_057950 | unspecified product |
| NCLIV_002590 | phthalate dioxygenase reductase subunit, related |
| NCLIV_055850 | unspecified product |
| NCLIV_046690 | VASA RNA helicase, related |
| NCLIV_065270 | hypothetical protein |
| NCLIV_020720 | putative microneme protein MIC11 |
| NCLIV_064700 | Ribosomal protein L18, related |
| NCLIV_011730 | unspecified product |
| NCLIV_005620 | putative articulin 4 |
| NCLIV_056480 | hypothetical protein |
| NCLIV_035250 | GK18150, related |
| NCLIV_057820 | hypothetical protein |
| NCLIV_001070 | histone H2B, related |
| NCLIV_066630 | unspecified product |
| NCLIV_064360 | 50S ribosomal protein L24P, related |
| NCLIV_009450 | 60s ribosomal protein L17, related |
| NCLIV_010200 | hypothetical protein |
| NCLIV_000510 | putative translocation protein sec62 |
| NCLIV_030860 | conserved hypothetical protein |
| NCLIV_018120 | conserved hypothetical protein |
| NCLIV_039030 | hypothetical protein |
| NCLIV_029420 | putative myosin light chain TgMLC1 |
| NCLIV_036280 | 30S ribosomal protein S15P/S13e, related |
| NCLIV_032780 | putative small heat shock protein 20 |
| NCLIV_065010 | hypothetical protein |
| NCLIV_046040 | hypothetical protein |
| NCLIV_041930 | unspecified product |
| NCLIV_027160 | conserved hypothetical protein |
| NCLIV_064440 | hypothetical protein |
| NCLIV_049600 | 30S ribosomal protein S8P, related |
| NCLIV_046800 | putative AGC kinase |
| NCLIV_066600 | DEHA2F06798p, related |
| NCLIV_028170 | unspecified product |
| NCLIV_055710 | putative 60S ribosomal protein L23 |
| NCLIV_011700 | unspecified product |
| NCLIV_037500 | unspecified product |
| NCLIV_036610 | hypothetical protein |
| NCLIV_038850 | putative fumarase |
| NCLIV_065590 | putative NAD-specific glutamate dehydrogenase |
| NCLIV_056700 | 26S proteasome regulatory subunit rpn1, related |
| NCLIV_014360 | hypothetical protein |

TABLE 3-continued

List of identified protein in EAE by LC-MS/MS analysis.

| Accession number[1] | Description[2] |
|---|---|
| NCLIV_043930 | kelch repeat-containing proteins that is fused to a HSP90-like ATpase, related |
| NCLIV_013150 | conserved hypothetical protein |
| NCLIV_032110 | conserved hypothetical protein |
| NCLIV_015160 | hypothetical protein |
| NCLIV_024840 | hypothetical protein |
| NCLIV_032770 | hypothetical protein |
| NCLIV_018400 | putative TCP-1/cpn60 family chaperonin |
| NCLIV_033250 | SRS domain-containing protein |
| NCLIV_063860 | putative thioredoxin |
| NCLIV_060660 | SRS domain-containing protein |
| NCLIV_041780 | lsu ribosomal protein L19E, related |
| NCLIV_027600 | conserved hypothetical protein |
| NCLIV_060220 | conserved hypothetical protein |
| NCLIV_004160 | histone H2B, related |
| NCLIV_062950 | 50S ribosomal protein L21e, related |
| NCLIV_031510 | hypothetical protein |
| NCLIV_056670 | conserved hypothetical protein |
| NCLIV_048020 | hypothetical protein |
| NCLIV_000740 | class I chitinase, related |
| NCLIV_051820 | hypothetical protein |
| NCLIV_042590 | 2-oxoglutarate dehydrogenase E1 component, related |
| NCLIV_054800 | conserved hypothetical protein |
| NCLIV_000940 | putative Glucose-6-phosphate dehydrogenase |
| NCLIV_059430 | hypothetical protein |
| NCLIV_018800 | hypothetical protein |
| NCLIV_062460 | conserved hypothetical protein |
| NCLIV_063970 | putative long chain acyl-CoA synthetase |
| NCLIV_004860 | hypothetical protein |
| NCLIV_043760 | conserved hypothetical protein |
| NCLIV_030820 | conserved hypothetical protein |
| NCLIV_006720 | conserved hypothetical protein |
| NCLIV_016540 | conserved hypothetical protein |
| NCLIV_054120 | unspecified product |
| NCLIV_042450 | putative opine dehydrogenase |
| NCLIV_031340 | putative Splicing factor 3B subunit 3 |
| NCLIV_015620 | 60S ribosomal protein L36, related |
| NCLIV_066250 | unspecified product |
| NCLIV_042070 | hypothetical protein |
| NCLIV_011270 | hypothetical protein |
| NCLIV_022970 | unspecified product |
| NCLIV_005010 | conserved hypothetical protein |
| NCLIV_028750 | hypothetical protein |
| NCLIV_030660 | putative TCP-1/cpn60 family chaperonin |
| NCLIV_034530 | putative TCP-1/cpn60 family chaperonin |
| NCLIV_025580 | eukaryotic translation initiation factor 3 subunit 11 |
| NCLIV_032050 | putative DnaJ domain-containing protein |
| NCLIV_055730 | hypothetical protein |
| NCLIV_056680 | hypothetical protein |
| NCLIV_043110 | putative interferon gamma-inducible protein 30 |
| NCLIV_053290 | ORF73, related |
| NCLIV_054570 | 60S ribosomal protein Ll28B 27a, related |
| NCLIV_026150 | Histone H3, related |
| NCLIV_028540 | conserved hypothetical protein |
| NCLIV_014020 | Peroxiredoxin-2E-1, related |
| NCLIV_060140 | putative inner membrane complex protein IMC3 |
| NCLIV_038320 | unspecified product |
| NCLIV_034270 | putative coatomer gamma 2-subunit protein |
| NCLIV_006070 | 30s ribosomal protein S10P, related |
| NCLIV_024250 | hypothetical protein |
| NCLIV_047630 | putative 40S ribosomal protein S18 |
| NCLIV_053840 | unspecified product |
| NCLIV_022950 | putative RNA-binding protein |
| NCLIV_027480 | hypothetical protein |
| NCLIV_033680 | Solute carrier family 25 (Mitochondrial carrier, dicarboxylate transporter), member 10, related |
| NCLIV_059450 | hypothetical protein |
| NCLIV_061040 | hypothetical protein |
| NCLIV_050210 | putative KH domain-containing protein |
| NCLIV_005900 | translation INITIATION FACTOR 3 SUBUNIT 9-like protein, related |
| NCLIV_065450 | hypothetical protein |
| NCLIV_027780 | conserved hypothetical protein |
| NCLIV_033270 | hypothetical protein |
| NCLIV_030930 | putative peroxiredoxin 3 |
| NCLIV_062940 | putative pyruvate dehydrogenase |
| NCLIV_064420 | putative ubiquitin |
| NCLIV_020180 | hypothetical protein |

TABLE 3-continued

List of identified protein in EAE by LC-MS/MS analysis.

| Accession number[1] | Description[2] |
|---|---|
| NCLIV_064880 | conserved hypothetical protein |
| NCLIV_004790 | putative 18 kDa cyclophilin |
| NCLIV_030490 | 30S ribosomal protein S12, related |
| NCLIV_052190 | conserved hypothetical protein |
| NCLIV_004730 | hypothetical protein |
| NCLIV_042650 | gg11844, related |
| NCLIV_015010 | conserved hypothetical protein |
| NCLIV_030890 | putative high molecular mass nuclear antigen |
| NCLIV_034090 | putative kinesin heavy chain |
| NCLIV_030620 | conserved hypothetical protein |
| NCLIV_070060 | RNA binding protein, putative |
| NCLIV_012830 | putative MORN repeat-containing protein |
| NCLIV_043300 | putative nucleolar phosphoprotein nucleolin |
| NCLIV_025450 | putative elongation factor Tu |
| NCLIV_060420 | hypothetical protein |
| NCLIV_006640 | hypothetical protein |
| NCLIV_059340 | conserved hypothetical protein |
| NCLIV_009640 | putative choline kinase |
| NCLIV_054720 | hypothetical protein |
| NCLIV_040970 | putative malate: quinone oxidoreductase |
| NCLIV_045870 | unspecified product |
| NCLIV_062570 | Contig An13c0020, complete genome, related |
| NCLIV_040440 | conserved hypothetical protein |
| NCLIV_040540 | hypothetical protein |
| NCLIV_053880 | cDNA FLJ54097, highly similar to Succinyl-CoA ligase (ADP-forming) beta-chain, mitochondrial, related |
| NCLIV_041790 | conserved hypothetical protein |
| NCLIV_057700 | hypothetical protein |
| NCLIV_051340 | putative toxofilin |
| NCLIV_038780 | 60s ribosomal protein L32, related |
| NCLIV_028090 | conserved hypothetical protein |
| NCLIV_053950 | hypothetical protein |
| NCLIV_024030 | conserved hypothetical protein |
| NCLIV_026600 | putative 46 kDa FK506-binding nuclear protein |
| NCLIV_000300 | conserved hypothetical protein |
| NCLIV_041940 | glyceraldehyde 3-phosphate dehydrogenase, related |
| NCLIV_026820 | conserved hypothetical protein |
| NCLIV_004400 | hypothetical protein |
| NCLIV_041120 | conserved hypothetical protein |
| NCLIV_016110 | hypothetical protein |
| NCLIV_020770 | hypothetical protein |
| NCLIV_004710 | hypothetical protein |
| NCLIV_004280 | hypothetical protein |
| NCLIV_001570 | eukaryotic translation initiation factor 3 subunit G-2, related |
| NCLIV_001450 | hypothetical protein |
| NCLIV_008730 | hypothetical protein |
| NCLIV_045650 | unspecified product |
| NCLIV_063980 | conserved hypothetical protein |
| NCLIV_033780 | YALI0B05610p, related |
| NCLIV_054520 | hypothetical protein |
| NCLIV_015180 | ATP synthase, related |
| NCLIV_060400 | hypothetical protein |
| NCLIV_041100 | novel protein (Zgc: 66430), related |
| NCLIV_006490 | putative myosin light chain 2 |
| NCLIV_023620 | SRS domain-containing protein |
| NCLIV_028050 | conserved hypothetical protein |
| NCLIV_006180 | putative duplicated carbonic anhydrase |
| NCLIV_070280 | hypothetical protein |
| NCLIV_012130 | eukaryotic translation initiation factor 3 subunit 7-like protein, related |
| NCLIV_023790 | conserved hypothetical protein |
| NCLIV_018550 | YGR231Cp-like protein, related |
| NCLIV_008230 | delta-aminolevulinic acid dehydratase, related |
| NCLIV_022540 | conserved hypothetical protein |
| NCLIV_060380 | hypothetical protein |
| NCLIV_027530 | putative lectin-domain protein |
| NCLIV_032920 | hypothetical protein |
| NCLIV_068890 | unspecified product |
| NCLIV_062280 | conserved hypothetical protein |
| NCLIV_011210 | transketolase, related |
| NCLIV_061990 | conserved hypothetical protein |
| NCLIV_001250 | putative guanylate binding protein |
| NCLIV_020360 | 40S ribosomal protein S12, related |
| NCLIV_018890 | L24, related |
| NCLIV_036410 | putative cyst matrix protein |
| NCLIV_058550 | conserved hypothetical protein |
| NCLIV_045220 | hypothetical protein |

TABLE 3-continued

List of identified protein in EAE by LC-MS/MS analysis.

| Accession number[1] | Description[2] |
|---|---|
| NCLIV_000130 | hypothetical protein |
| NCLIV_060700 | SRS domain-containing protein |
| NCLIV_044410 | unspecified product |
| NCLIV_038750 | putative DNAJ domain-containing protein |
| NCLIV_028060 | conserved hypothetical protein |
| NCLIV_030900 | hypothetical protein |
| NCLIV_041240 | nadh dehydrogenase, related |
| NCLIV_014150 | unspecified product |
| NCLIV_028240 | putative Ras family domain-containing protein |
| NCLIV_046550 | Elongation factor 1-beta, related |
| NCLIV_062730 | hypothetical protein |
| NCLIV_064310 | GTP-binding nuclear protein Ran, related |
| NCLIV_043400 | proteasome subunit p58, related |
| NCLIV_052240 | putative saccharopine dehydrogenase |
| NCLIV_054200 | Zgc: 92083, related |
| NCLIV_021720 | conserved hypothetical protein |
| NCLIV_018500 | Fatty acyl-CoA synthetase 2, related |
| NCLIV_049030 | hypothetical protein |
| NCLIV_029080 | hypothetical protein |
| NCLIV_041830 | os07g0543600 protein, related |
| NCLIV_006510 | putative TCP-1/cpn60 family chaperonin |
| NCLIV_051450 | putative centromere/microtubule binding protein |
| NCLIV_054250 | Acyl-CoA synthetase, related |
| NCLIV_049100 | Ribosomal protein S19e, related |
| NCLIV_057960 | unspecified product |
| NCLIV_002780 | yml024wp-like protein, related |
| NCLIV_052230 | Succinate dehydrogenase iron-sulfur subunit, related |
| NCLIV_056360 | Eukaryotic initiation factor, related |
| NCLIV_056300 | conserved hypothetical protein |
| NCLIV_066870 | hypothetical protein |
| NCLIV_048030 | hypothetical protein |
| NCLIV_006060 | conserved hypothetical protein |
| NCLIV_015480 | emp24/gp25L/p24 family domain-containing, transmembrane protein |
| NCLIV_032910 | hypothetical protein |
| NCLIV_039090 | conserved hypothetical protein |
| NCLIV_051560 | Glucose transporter 1A, related |
| NCLIV_007450 | unspecified product |
| NCLIV_012400 | Articulin family protein, related |
| NCLIV_063340 | hypothetical protein |
| NCLIV_020990 | hypothetical protein |
| NCLIV_051010 | putative signal peptide peptidase domain-containing protein |
| NCLIV_019000 | putative adenosine transporter |
| NCLIV_060760 | putative prolyl-tRNA synthetase |
| NCLIV_000840 | thioredoxin h, related |
| NCLIV_060860 | Cytochrome c, related |
| NCLIV_064530 | Histone H2A, related |
| NCLIV_027290 | Ribosomal protein S21-maize (ISS), related |
| NCLIV_007110 | hypothetical protein |
| NCLIV_006780 | conserved hypothetical protein |
| NCLIV_064840 | conserved hypothetical protein |
| NCLIV_019970 | Peptidyl-prolyl cis-trans isomerase A, related |
| NCLIV_011550 | novel protein (Zgc: 77155), related |
| NCLIV_012195 | unspecified product |
| NCLIV_0260 | armadillo/beta-catenin-like repeat-containing protein |
| NCLIV_051840 | hypothetical protein |
| NCLIV_043880 | hypothetical protein |
| NCLIV_055690 | hypothetical protein |
| NCLIV_054750 | hypothetical protein |
| NCLIV_065970 | conserved hypothetical protein |
| NCLIV_030170 | hypothetical protein |
| NCLIV_004380 | cathepsin L, related |
| NCLIV_035910 | hypothetical protein |
| NCLIV_039080 | adaptin N terminal region family protein, related |
| NCLIV_042390 | conserved hypothetical protein |
| NCLIV_033850 | hypothetical protein |
| NCLIV_064540 | Ribosomal protein L37a, related |
| NCLIV_000860 | spatr, related |
| NCLIV_004750 | putative peptidase family M48 domain-containing protein |
| NCLIV_047520 | conserved hypothetical protein |
| NCLIV_066900 | putative serine/threonine protein phosphatase 5 |
| NCLIV_062630 | Thioredoxin-dependent peroxide reductase, mitochondrial, related |
| NCLIV_051490 | conserved hypothetical protein |
| NCLIV_029730 | putative Ras family domain-containing protein |
| NCLIV_050300 | GH18750, related |
| NCLIV_038000 | CUG-BP and ETR-3-like factor 3, related |
| NCLIV_056550 | Translation initiation factor 2 subunit alpha (AeIF-2a), related |

TABLE 3-continued

List of identified protein in EAE by LC-MS/MS analysis.

| Accession number[1] | Description[2] |
|---|---|
| NCLIV_063370 | conserved hypothetical protein |
| NCLIV_045260 | hypothetical protein |
| NCLIV_003190 | putative mitochondrial carrier domain-containing protein |
| NCLIV_053330 | conserved hypothetical protein |
| NCLIV_004300 | putative dynamin-like protein |
| NCLIV_067050 | conserved hypothetical protein |
| NCLIV_002390 | nucleoside diphosphate kinase, related |
| NCLIV_020650 | putative splicing factor 3B subunit 1 |
| NCLIV_055160 | conserved hypothetical protein |
| NCLIV_018290 | Ribosomal protein S26E, related |
| NCLIV_016380 | Ribosomal protein L22, related |
| NCLIV_003650 | hypothetical protein |
| NCLIV_004920 | hypothetical protein |
| NCLIV_058840 | conserved hypothetical protein |
| NCLIV_052500 | hypothetical protein |
| NCLIV_002770 | putative MORN repeat-containing protein |
| NCLIV_069630 | hypothetical protein, conserved |
| NCLIV_034990 | Transketolase, pyridine binding domain protein, related |
| NCLIV_066100 | putative microtubule-binding protein |
| NCLIV_018020 | hypothetical protein |
| NCLIV_013260 | conserved hypothetical protein |
| NCLIV_012510 | hypothetical protein |
| NCLIV_013320 | hypothetical protein |
| NCLIV_052380 | hypothetical protein |
| NCLIV_062890 | hypothetical protein |
| NCLIV_031040 | Peptidyl-prolyl cis-trans isomerase, related |
| NCLIV_045670 | hypothetical protein |
| NCLIV_034470 | hypothetical protein |
| NCLIV_066970 | putative enoyl-acyl carrier reductase |
| NCLIV_046530 | putative reticulon domain-containing protein |
| NCLIV_061940 | hypothetical protein |
| NCLIV_069550 | unspecified product |
| NCLIV_026430 | DnaJ domain containing protein, related |
| NCLIV_049570 | hypothetical protein |
| NCLIV_019450 | hypothetical protein |
| NCLIV_025010 | hypothetical protein |
| NCLIV_016970 | conserved hypothetical protein |
| NCLIV_031460 | conserved hypothetical protein |
| NCLIV_044290 | pyruvate dehydrogenase E2 component, related |
| NCLIV_042660 | probable cytosol aminopeptidase, related |
| NCLIV_064580 | hypothetical protein |
| NCLIV_014950 | putative trans-2,3-enoyl-CoA reductase |
| NCLIV_005420 | phosphoglycerate kinase, related |
| NCLIV_006570 | putative serine/threonine protein phosphatase |
| NCLIV_054110 | YHL017Wp-like protein, related |
| NCLIV_009390 | putative Cleft lip and palate transmembrane protein 1 |
| NCLIV_051800 | conserved hypothetical protein |
| NCLIV_032220 | 50S ribosomal protein L30e, related |
| NCLIV_052510 | hypothetical protein |
| NCLIV_016120 | putative proteasome subunit alpha type 4, subunit |
| NCLIV_038680 | hypothetical protein |
| NCLIV_047080 | conserved hypothetical protein |
| NCLIV_032560 | hypothetical protein |
| NCLIV_038540 | rab22a, member RAS oncogene family, related |
| NCLIV_042050 | hypothetical protein |
| NCLIV_063740 | conserved hypothetical protein |
| NCLIV_032620 | Cs1 protein, related |
| NCLIV_060500 | conserved hypothetical protein |
| NCLIV_029570 | conserved hypothetical protein |
| NCLIV_007390 | mgc78841 protein, related |
| NCLIV_014430 | conserved hypothetical protein |
| NCLIV_000430 | conserved hypothetical protein |
| NCLIV_069130 | hypothetical protein, conserved |
| NCLIV_015200 | Pyruvate kinase, related |
| NCLIV_044350 | conserved hypothetical protein |
| NCLIV_024860 | Proteasome/cyclosome repeat family protein, related |
| NCLIV_001370 | putative DEAD/DEAH box helicase |
| NCLIV_015790 | putative fatty acyl-CoA desaturase |
| NCLIV_040610 | virulent strain associated lipoprotein, related |
| NCLIV_000710 | conserved hypothetical protein |
| NCLIV_045240 | putative eukaryotic translation initiation factor 3 subunit 5 |
| NCLIV_061210 | conserved hypothetical protein |
| NCLIV_069600 | hypothetical protein, conserved |
| NCLIV_048880 | Proteasome subunit beta type-7, related |
| NCLIV_048040 | conserved hypothetical protein |
| NCLIV_029860 | hypothetical protein |

TABLE 3-continued

List of identified protein in EAE by LC-MS/MS analysis.

| Accession number[1] | Description[2] |
|---|---|
| NCLIV_019830 | hypothetical protein |
| NCLIV_009780 | beta-lactamase domain protein (Precursor), related |
| NCLIV_022140 | GA11385, related |
| NCLIV_018710 | hypothetical protein |
| NCLIV_016370 | Galactosyltransferase, related |
| NCLIV_041650 | methionine--tRNAligase, related |
| NCLIV_050390 | Pyrroline-5-carboxylate reductase, related |
| NCLIV_039000 | probable 26S protease regulatory subunit 6B, related |
| NCLIV_068380 | hypothetical protein |
| NCLIV_047390 | conserved hypothetical protein |
| NCLIV_025000 | hypothetical protein |
| NCLIV_037760 | Rhomboid-6, isoform A, related |
| NCLIV_051890 | unspecified product |
| NCLIV_002380 | conserved hypothetical protein |
| NCLIV_020340 | unspecified product |
| NCLIV_012230 | Ribose-phosphate pyrophosphokinase, related |
| NCLIV_068970 | Succinate dehydrogenase flavoprotein subunit, related |
| NCLIV_012890 | hypothetical protein |
| NCLIV_024830 | conserved hypothetical protein |
| NCLIV_011320 | vesicle-associated membrane protein-associated protein A, related |
| NCLIV_062310 | Function: human SRp75 can complement a splicing-deficient extract, related |
| NCLIV_018510 | Hydrolase Cof, related |
| NCLIV_060800 | Ubiquitin, related |
| NCLIV_044230 | putative peptidase M16 domain containing protein |
| NCLIV_010010 | het-R, related |
| NCLIV_062770 | unspecified product |
| NCLIV_039500 | hypothetical protein |
| NCLIV_004140 | hypothetical protein |
| NCLIV_025910 | Histone H2A, related |
| NCLIV_021640 | unspecified product |
| NCLIV_011820 | agap011504-PA, related |
| NCLIV_006030 | putative dynein light chain |
| NCLIV_061560 | conserved hypothetical protein |
| NCLIV_000610 | putative profilin family protein |
| NCLIV_053870 | hypothetical protein |
| NCLIV_041210 | putative Ubiquinol-cytochrome c reductase complex 14 kDa protein |
| NCLIV_024070 | conserved hypothetical protein |
| NCLIV_061440 | hypothetical protein |
| NCLIV_003580 | conserved hypothetical protein |
| NCLIV_046830 | putative ATP synthase |
| NCLIV_047040 | conserved hypothetical protein |
| NCLIV_063330 | Ubiquinol-cytochrome c reductase cytochrome c1 subunit, related |
| NCLIV_022420 | hypothetical protein |
| NCLIV_063150 | Serpin peptidase inhibitor, clade B (Ovalbumin), member 1, like 3, related |
| NCLIV_010020 | ubiquinol-cytochrome c reductase iron-sulfur subunit, related |
| NCLIV_053810 | Os03g0795800 protein, related |
| NCLIV_027850 | unspecified product |
| NCLIV_042510 | conserved hypothetical protein |
| NCLIV_044440 | hypothetical protein |
| NCLIV_014040 | conserved hypothetical protein |
| NCLIV_004060 | conserved hypothetical protein |
| NCLIV_015990 | hypothetical protein |
| NCLIV_040600 | hypothetical protein |
| NCLIV_018830 | conserved hypothetical protein |
| NCLIV_039750 | hypothetical protein |
| NCLIV_058180 | unspecified product |
| NCLIV_049830 | conserved hypothetical protein |
| NCLIV_031860 | putative serine-threonine phosphatase 2C |
| NCLIV_045440 | putative proteasome PCI domain-containing protein |
| NCLIV_025730 | conserved hypothetical protein |
| NCLIV_061030 | hypothetical protein |
| NCLIV_063190 | conserved hypothetical protein |
| NCLIV_017340 | hypothetical protein |
| NCLIV_027930 | unspecified product |
| NCLIV_026180 | hypothetical protein |
| NCLIV_019930 | conserved hypothetical protein |
| NCLIV_053940 | 60S acidic ribosomal protein P2, related |
| NCLIV_029690 | conserved hypothetical protein |
| NCLIV_005040 | conserved hypothetical protein |
| NCLIV_036130 | CBR-RSP-4 protein, related |
| NCLIV_026390 | putative centrin |
| NCLIV_008410 | gamma-aminobutyric acid receptor-associated protein-like 1, related |
| NCLIV_056910 | conserved hypothetical protein |
| NCLIV_068520 | unspecified product |
| NCLIV_065750 | Alpha 2 subunit of 20S proteasome (ISS), related |
| NCLIV_059980 | conserved hypothetical protein |

TABLE 3-continued

List of identified protein in EAE by LC-MS/MS analysis.

| Accession number[1] | Description[2] |
|---|---|
| NCLIV_066350 | Os06g0732000 protein, related |
| NCLIV_035190 | conserved hypothetical protein |
| NCLIV_058260 | hypothetical protein |
| NCLIV_001660 | conserved hypothetical protein |
| NCLIV_028110 | putative DnaJ protein |
| NCLIV_026540 | conserved hypothetical protein |
| NCLIV_025220 | conserved hypothetical protein |
| NCLIV_009030 | metallophosphoesterase, related |
| NCLIV_066080 | conserved hypothetical protein |
| NCLIV_020140 | hypothetical protein |
| NCLIV_026270 | 26S proteasome regulatory subunit S4 like AAA ATpase, related |
| NCLIV_007900 | pv1h14125_P, related |
| NCLIV_011140 | gl18351, related |
| NCLIV_050620 | putative lysine decarboxylase domain-containing protein |
| NCLIV_026210 | hypothetical protein |
| NCLIV_042680 | conserved hypothetical protein |
| NCLIV_040550 | conserved hypothetical protein |
| NCLIV_038410 | predicted hydrolases or acyltransferases, related |
| NCLIV_050910 | conserved hypothetical protein |
| NCLIV_017990 | conserved hypothetical protein |
| NCLIV_003160 | nicotinate phosphoribosyltransferase, related |
| NCLIV_031500 | hypothetical protein |
| NCLIV_040860 | tryptophanyl-tRNAsynthetase, related |
| NCLIV_044840 | conserved hypothetical protein |
| NCLIV_036570 | YALI0D21604p, related |
| NCLIV_056950 | hypothetical protein |
| NCLIV_062880 | conserved hypothetical protein |
| NCLIV_011400 | putative ATP-dependent helicase |
| NCLIV_037460 | hypothetical protein |
| NCLIV_015260 | conserved hypothetical protein |
| NCLIV_013460 | hypothetical protein |
| NCLIV_049130 | putative XPG N-terminal domain containing protein |
| NCLIV_062350 | Ribosomal protein S27, related |
| NCLIV_028310 | conserved hypothetical protein |
| NCLIV_051110 | conserved hypothetical protein |
| NCLIV_028230 | Proteasome subunit alpha type-7, related |
| NCLIV_039960 | hypothetical protein |
| NCLIV_053890 | conserved hypothetical protein |
| NCLIV_036250 | Asparaginyl-tRNA synthetase, related |
| NCLIV_010970 | hypothetical protein |
| NCLIV_029040 | putative nucleosome assembly protein |
| NCLIV_045600 | putative glycosyl transferase, group 1 domain containing protein |
| NCLIV_024090 | putative glutamyl-tRNA synthetase |
| NCLIV_038570 | conserved hypothetical protein |
| NCLIV_032940 | putative adenosine transporter |
| NCLIV_003560 | putative mitochondrial alternative NADH dehydrogenase 1 |
| NCLIV_004270 | putative protein kinase |
| NCLIV_007330 | similar to uniprot|P15705 *Saccharomyces cerevisiae* YOR027w STI1, related |
| NCLIV_047530 | conserved hypothetical protein |
| NCLIV_043180 | hypothetical protein |
| NCLIV_043670 | high mobility group protein, related |
| NCLIV_024230 | Zgc: 123215, related |
| NCLIV_054540 | RAB5C, member RAS oncogene family, related |
| NCLIV_013360 | putative plectin |
| NCLIV_022270 | unspecified product |
| NCLIV_020920 | conserved hypothetical protein |
| NCLIV_044600 | conserved hypothetical protein |
| NCLIV_024410 | 10 kDa chaperonin, related |
| NCLIV_051970 | putative MIC2-associated protein M2AP |
| NCLIV_014760 | conserved hypothetical protein |
| NCLIV_029060 | conserved hypothetical protein |
| NCLIV_058450 | putative myosin regulatory light chain |
| NCLIV_054190 | hypothetical protein |
| NCLIV_017840 | conserved hypothetical protein |
| NCLIV_045430 | putative DNA-binding protein HU |
| NCLIV_046030 | hypothetical protein |
| NCLIV_056110 | putative small heat shock protein 21 |
| NCLIV_065830 | MGC79800 protein, related |
| NCLIV_003220 | putative vacuolar ATP synthase subunit h |
| NCLIV_044120 | conserved hypothetical protein |
| NCLIV_064810 | hypothetical protein |
| NCLIV_015530 | conserved hypothetical protein |
| NCLIV_048050 | conserved hypothetical protein |
| NCLIV_020430 | hypothetical protein |
| NCLIV_067220 | conserved hypothetical protein |
| NCLIV_030070 | conserved hypothetical protein |

TABLE 3-continued

List of identified protein in EAE by LC-MS/MS analysis.

| Accession number[1] | Description[2] |
| --- | --- |
| NCLIV_064600 | putative cysteine desulfurase |
| NCLIV_019750 | conserved hypothetical protein |
| NCLIV_050030 | hypothetical protein |
| NCLIV_057710 | putative ATP synthase epsilon chain |
| NCLIV_024320 | conserved hypothetical protein |
| NCLIV_062710 | conserved hypothetical protein |
| NCLIV_009670 | cold-shock protein, DNA-binding, related |
| NCLIV_021100 | unspecified product |
| NCLIV_052880 | unspecified product |
| NCLIV_039480 | hypothetical protein |
| NCLIV_003680 | 40s ribosomal protein S28, related |
| NCLIV_051460 | conserved hypothetical protein |
| NCLIV_008890 | putative tim10/DDP zinc finger domain-containing protein |
| NCLIV_066190 | putative caltractin |
| NCLIV_011960 | conserved hypothetical protein |
| NCLIV_055330 | Fibrillarin superfamily, related |
| NCLIV_026340 | hypothetical protein |
| NCLIV_044100 | conserved hypothetical protein |
| NCLIV_018950 | putative coatomer epsilon subunit |
| NCLIV_022560 | Thermosome subunit, related |
| NCLIV_044950 | conserved hypothetical protein |
| NCLIV_027660 | conserved hypothetical protein |
| NCLIV_068630 | conserved hypothetical protein |
| NCLIV_055370 | conserved hypothetical protein |
| NCLIV_046840 | Acyl-carrier-protein S-malonyltransferase, related |
| NCLIV_056250 | hypothetical protein |
| NCLIV_048600 | hypothetical protein |
| NCLIV_032030 | conserved hypothetical protein |
| NCLIV_070190 | Dihydrolipoyl dehydrogenase (EC 1.8.1.4), related |
| NCLIV_017240 | conserved hypothetical protein |
| NCLIV_010610 | hypothetical protein |
| NCLIV_007000 | adp-ribosylation factor 4, related |
| NCLIV_050630 | H/ACA ribonucleoprotein complex subunit 2-like protein, related |
| NCLIV_052070 | hypothetical protein |
| NCLIV_023540 | putative aldo/keto reductase family oxidoreductase |
| NCLIV_066370 | hypothetical protein |
| NCLIV_057460 | Transketolase central region, related |
| NCLIV_019780 | putative KH domain containing protein |
| NCLIV_026100 | conserved hypothetical protein |
| NCLIV_019480 | proteasome A-type and B-type domain-containing protein |
| NCLIV_068640 | putative protein phosphatase 2C |
| NCLIV_065500 | conserved hypothetical protein |
| NCLIV_039280 | isocitrate dehydrogenase-like protein, related |
| NCLIV_014330 | Prolyl oligopeptidase (Precursor), related |
| NCLIV_010390 | novel protein (Zgc: 77804), related |
| NCLIV_004810 | conserved hypothetical protein |
| NCLIV_035590 | conserved hypothetical protein |
| NCLIV_021410 | conserved hypothetical protein |
| NCLIV_016420 | putative pescadillo family protein |
| NCLIV_039820 | cDNA FLJ57348, highly similar to Homo sapiens hexokinase domain containing 1 (HKDC1), mRNA, related |
| NCLIV_003600 | putative ABC transporter |
| NCLIV_046890 | conserved hypothetical protein |
| NCLIV_067160 | hypothetical protein |
| NCLIV_055450 | putative FUN14 family domain-containing protein |
| NCLIV_011040 | putative N-ethylmaleimide-sensitive factor |
| NCLIV_018560 | putative ras-GTPase-activating protein binding protein |
| NCLIV_027230 | Dihydropteroate synthase, related |
| NCLIV_024220 | putative glycerol-3-phosphate dehydrogenase |
| NCLIV_003890 | conserved hypothetical protein |
| NCLIV_065820 | hypothetical protein |
| NCLIV_013130 | conserved hypothetical protein = 1139 |
| NCLIV_060920 | conserved hypothetical protein |
| NCLIV_046460 | conserved hypothetical protein |
| NCLIV_033810 | hypothetical protein |
| NCLIV_069460 | hypothetical protein |
| NCLIV_031440 | 60S ribosomal protein L38, related |
| NCLIV_036510 | hypothetical protein |
| NCLIV_025280 | conserved hypothetical protein |
| NCLIV_007105 | unspecified product |
| NCLIV_017460 | putative NUDIX hydrolase domain-containing protein |
| NCLIV_063760 | hypothetical protein |
| NCLIV_000280 | ranbp1 domain containing protein, related |
| NCLIV_030650 | putative 26S protease regulatory subunit 6b |
| NCLIV_024140 | hypothetical protein |
| NCLIV_035310 | putative inhibitor-1 of protein phosphatase type 2A |

TABLE 3-continued

List of identified protein in EAE by LC-MS/MS analysis.

| Accession number[1] | Description[2] |
|---|---|
| NCLIV_046540 | putative oligoendopeptidase F |
| NCLIV_066770 | putative seryl-tRNA synthetase |
| NCLIV_010650 | conserved hypothetical protein |
| NCLIV_056830 | putative 60S ribosomal protein L7a |
| NCLIV_053590 | WD-40 repeat protein, related |
| NCLIV_053640 | putative peroxidoxin 2 |
| NCLIV_054910 | conserved hypothetical protein |
| NCLIV_058360 | hypothetical protein |
| NCLIV_024380 | conserved hypothetical protein |
| NCLIV_049400 | Serine hydroxymethyltransferase, related |
| NCLIV_067490 | putative protein phosphatase 2C |
| NCLIV_023990 | Acyl carrier protein, related |
| NCLIV_058420 | conserved hypothetical protein |
| NCLIV_001360 | conserved hypothetical protein |
| NCLIV_036720 | CBR-CSN-5 protein, related |
| NCLIV_037060 | hypothetical protein |
| NCLIV_008960 | hypothetical protein |
| NCLIV_030470 | conserved hypothetical protein |
| NCLIV_013910 | Pdcd4-prov protein, related |
| NCLIV_012500 | conserved hypothetical protein |
| NCLIV_029255 | unspecified product |
| NCLIV_056440 | Signal recognition particle GTPase, related |
| NCLIV_054410 | Calr protein, related |
| NCLIV_033275 | unspecified product |
| NCLIV_018460 | conserved hypothetical protein |
| NCLIV_046970 | conserved hypothetical protein |
| NCLIV_048240 | hypothetical protein |
| NCLIV_021570 | conserved hypothetical protein |
| NCLIV_027770 | hypothetical protein |
| NCLIV_054460 | conserved hypothetical protein |
| NCLIV_022690 | conserved hypothetical protein |
| NCLIV_046580 | conserved hypothetical protein |
| NCLIV_036300 | conserved hypothetical protein |
| NCLIV_025600 | putative calmodulin2 |
| NCLIV_008990 | unspecified product |
| NCLIV_041870 | hypothetical protein |
| NCLIV_060890 | putative Ras family domain-containing protein |
| NCLIV_027270 | putative cell division protein |
| NCLIV_047010 | conserved hypothetical protein |
| NCLIV_044340 | conserved hypothetical protein |
| NCLIV_008900 | yali0d05697p, related \| location |
| NCLIV_051960 | conserved hypothetical protein |
| NCLIV_058810 | superoxide dismutase |
| NCLIV_006170 | phosphoglycerate mutase, related |
| NCLIV_054840 | conserved hypothetical protein |
| NCLIV_016430 | conserved hypothetical protein |
| NCLIV_045530 | conserved hypothetical protein |
| NCLIV_007180 | hypothetical protein |
| NCLIV_020880 | hypothetical protein |
| NCLIV_023130 | conserved hypothetical protein |
| NCLIV_003420 | putative elongation factor ts |
| NCLIV_048580 | hypothetical protein |
| NCLIV_065910 | conserved hypothetical protein |
| NCLIV_007120 | hypothetical protein |
| NCLIV_004340 | hypothetical protein |
| NCLIV_044820 | conserved hypothetical protein |
| NCLIV_044850 | conserved hypothetical protein |
| NCLIV_054510 | putative heat shock protein 90 |
| NCLIV_026520 | conserved hypothetical protein |
| NCLIV_006940 | conserved hypothetical protein |
| NCLIV_049920 | conserved hypothetical protein |
| NCLIV_052000 | putative DNA replication licensing factor |
| NCLIV_032160 | putative UBA/TS-N domain-containing protein |
| NCLIV_001930 | conserved hypothetical protein |
| NCLIV_032830 | hypothetical protein |
| NCLIV_032180 | GK24228, related |
| NCLIV_052270 | conserved hypothetical protein |
| NCLIV_068620 | putative Ribosome associated membrane domain-containing protein |
| NCLIV_025130 | Translation initiation factor 1A (AeIF-1A), related |
| NCLIV_049080 | hypothetical protein |
| NCLIV_054280 | conserved hypothetical protein |
| NCLIV_045490 | conserved hypothetical protein |
| NCLIV_038830 | sm protein, related |
| NCLIV_031530 | hypothetical protein |
| NCLIV_038390 | hypothetical protein |
| NCLIV_013780 | hypothetical protein |

TABLE 3-continued

List of identified protein in EAE by LC-MS/MS analysis.

| Accession number[1] | Description[2] |
|---|---|
| NCLIV_054960 | putative vacuolar ATP synthase subunit f |
| NCLIV_055190 | putative myosin light chain TgMLC1 |
| NCLIV_030910 | LRRGT00025, related |
| NCLIV_004570 | hypothetical protein |
| NCLIV_003110 | conserved hypothetical protein |
| NCLIV_024600 | hypothetical protein |
| NCLIV_051040 | conserved hypothetical protein |
| NCLIV_059830 | conserved hypothetical protein |
| NCLIV_046140 | conserved hypothetical protein |
| NCLIV_008650 | hypothetical protein |
| NCLIV_014050 | conserved hypothetical protein |
| NCLIV_068650 | putative endoplasmic reticulum retention receptor |
| NCLIV_065410 | putative ctr copper transporter domain-containing protein |
| NCLIV_037400 | putative la domain-containing protein |
| NCLIV_030630 | p25-alpha family protein, related |
| NCLIV_046900 | hypothetical protein |
| NCLIV_059790 | putative proteasome subunit alpha type 3 |
| NCLIV_010050 | srs domain-containing protein |
| NCLIV_066820 | putative proteasome activator subunit |
| NCLIV_061340 | hypothetical protein |
| NCLIV_063610 | conserved hypothetical protein |
| NCLIV_003990 | conserved hypothetical protein |
| NCLIV_037540 | YOR039Wp-like protein, related |
| NCLIV_028870 | Peptidylprolyl isomerase D (Cyclophilin D), related |
| NCLIV_058310 | putative vacuolar ATP synthase subunit c |
| NCLIV_026040 | putative structure specific recognition protein I |
| NCLIV_024990 | conserved hypothetical protein |
| NCLIV_046390 | hypothetical protein |
| NCLIV_049110 | hypothetical protein |
| NCLIV_031030 | conserved hypothetical protein |
| NCLIV_043070 | hypothetical protein |
| NCLIV_011840 | hypothetical protein |
| NCLIV_060330 | putative molybdopterin cofactor sulfurase |
| NCLIV_053970 | conserved hypothetical protein |
| NCLIV_034650 | conserved hypothetical protein |
| NCLIV_045860 | hypothetical protein |
| NCLIV_029800 | conserved hypothetical protein |
| NCLIV_045190 | Proteophosphoglycan ppg1, related |
| NCLIV_005550 | hypothetical protein |
| NCLIV_052950 | SRS domain-containing protein |
| NCLIV_065640 | putative Rhoptry kinase family protein, truncated (incomplete catalytic triad) |
| NCLIV_033030 | conserved hypothetical protein |
| NCLIV_046620 | *Plasmodium vivax* PV1H14060_P, related |
| NCLIV_069400 | hypothetical protein, conserved |
| NCLIV_009170 | proteasome (Prosome, macropain) subunit, beta type, 1, related |
| NCLIV_022080 | hypothetical protein |
| NCLIV_062220 | Glutaminyl-tRNA synthetase, related |
| NCLIV_049150 | conserved hypothetical protein |
| NCLIV_056560 | putative DEAD/DEAH box helicase |
| NCLIV_045350 | conserved hypothetical protein |
| NCLIV_024360 | hypothetical protein |
| NCLIV_0155 | alpha/beta hydrolase fold domain containing protein |
| NCLIV_033090 | putative rhoGAP protein |
| NCLIV_002660 | hypothetical protein |
| NCLIV_067260 | Diaminopimelate decarboxylase protein, related |
| NCLIV_032250 | conserved hypothetical protein |
| NCLIV_016220 | unspecified product |
| NCLIV_053680 | hypothetical protein |
| NCLIV_035750 | putative vacuolar protein sorting-associated protein |
| NCLIV_040040 | grpe protein homolog, related |
| NCLIV_004680 | conserved hypothetical protein |
| NCLIV_014450 | Phosphoglucomutase 2, related |
| NCLIV_016520 | hypothetical protein |
| NCLIV_013840 | hypothetical protein |
| NCLIV_062610 | Zdhhc9 protein, related |
| NCLIV_008860 | hypothetical protein |
| NCLIV_060110 | conserved hypothetical protein |
| NCLIV_063620 | conserved hypothetical protein |
| NCLIV_051920 | conserved hypothetical protein |
| NCLIV_060990 | hypothetical protein |
| NCLIV_063490 | conserved hypothetical protein |
| NCLIV_068580 | hypothetical protein |
| NCLIV_065770 | putative nuclear cap binding protein |
| NCLIV_051440 | putative WD-40 repeat protein |
| NCLIV_047350 | conserved hypothetical protein |
| NCLIV_060640 | putative Gpi16 subunit, GPI transamidase domain-containing protein |

TABLE 3-continued

List of identified protein in EAE by LC-MS/MS analysis.

| Accession number[1] | Description[2] |
|---|---|
| NCLIV_004700 | conserved hypothetical protein |
| NCLIV_060900 | conserved hypothetical protein |
| NCLIV_061290 | putative DEAD/DEAH box RNA helicase |
| NCLIV_043870 | conserved hypothetical protein |
| NCLIV_047370 | conserved hypothetical protein |
| NCLIV_055820 | hypothetical protein |

[1]Accession number for the identified protein in ToxoDB database (ToxoDB-13.0_NcaninumLIV_AnnotatedProteins; 7122 sequences; Date 9 Feb. 2015) (Gajria et al., 2008, Nucleic Acids Res. 36; Database issue: D553-556).
[2]Protein description in ToxoDB database (ToxoDB-13.0_NcaninumLIV_AnnotatedProteins; 7122 sequences; Date 9 Feb. 2015) (Gajria et al., 2008, Nucleic Acids Res. 36; Database issue: D553-556).

4.2.2. Relative Quantification Between EAE and WTE.

After peak alignment and normalization of peptide features using Progenesis software, Mascot search of differentially abundant peptides between EAE and WTE conditions resulted in the identification of 998 proteins under the following acceptance criteria: FDR<1%, peptides with individual ion scores >13, and differences in peptide abundance ($p<0.05$) between EAE and WTE. After protein identification following criteria: FDR<1% and two or more of non-conflicting unique peptides (CI>95%), 622 proteins showed significant differences in protein abundance (ANOVA p-value <0.05) between WTE and EAE. 546 differentially abundant proteins with a fold change ≥1.5 (ANOVA, $p<0.05$) were identified. From these, 261 were significantly increased in EAE samples (Table 4) and 285 were significantly increased in WTE samples (or, therefore, significantly decreased in EAE samples) (Table 5). Furthermore, from those 261 identified proteins increased in EAE, 53 showed a significant increase with a fold change ≥2 (Table 4) and from those 285 proteins significantly increased in WTE, 221 showed a significant increase with a fold change ≥2 (Table 5).

TABLE 4

Relative quantification (fold change) of EAE and WTE samples. Data of proteins with a fold change ≥1.5 (ANOVA, p < 0.05) in EAE vs WTE samples are shown.

| Accession number[1] | Peptides[2] | Score | Anova (p)[3] | Fold change (EAE/WTE)[4] | Description[5] |
|---|---|---|---|---|---|
| NCLIV_018120 | 2 | 36.58 | 7.34E−05 | 4.15 | conserved hypothetical protein |
| NCLIV_003410 | 2 | 31.67 | 1.34E−03 | 3.35 | putative HECT-domain (ubiquitin-transferase) containing protein |
| NCLIV_058550 | 2 | 53.23 | 1.08E−03 | 3.33 | conserved hypothetical protein |
| NCLIV_042610 | 2 | 30.14 | 0.03 | 3.06 | conserved hypothetical protein |
| NCLIV_032910 | 2 | 60.26 | 1.52E−03 | 2.99 | hypothetical protein |
| NCLIV_024830 | 2 | 144.97 | 1.35E−07 | 2.7 | conserved hypothetical protein |
| NCLIV_015180 | 5 | 269.78 | 8.94E−05 | 2.52 | ATP synthase, related |
| NCLIV_066970 | 3 | 251.91 | 9.14E−04 | 2.48 | putative enoyl-acyl carrier reductase |
| NCLIV_025730 | 2 | 80.52 | 1.22E−03 | 2.47 | conserved hypothetical protein |
| NCLIV_006640 | 4 | 153.37 | 4.05E−04 | 2.42 | hypothetical protein |
| NCLIV_003470 | 2 | 53.96 | 3.70E−03 | 2.39 | putative thrombospondin type 1 domain-containing protein |
| NCLIV_019000 | 2 | 151.71 | 9.48E−05 | 2.37 | putative adenosine transporter |
| NCLIV_054510 | 3 | 122.25 | 6.93E−05 | 2.36 | putative heat shock protein 90 |
| NCLIV_066350 | 2 | 64.4 | 0.01 | 2.35 | Os06g0732000 protein, related |
| NCLIV_057020 | 2 | 37.21 | 5.92E−05 | 2.32 | conserved hypothetical protein |
| NCLIV_056680 | 4 | 151.06 | 1.75E−05 | 2.3 | hypothetical protein |
| NCLIV_044290 | 4 | 141.14 | 2.07E−04 | 2.29 | pyruvate dehydrogenase E2 component, related |
| NCLIV_032030 | 2 | 81.49 | 3.17E−03 | 2.27 | conserved hypothetical protein |
| NCLIV_052240 | 2 | 77.25 | 1.58E−04 | 2.27 | putative saccharopine dehydrogenase |
| NCLIV_008730 | 3 | 212.46 | 2.08E−04 | 2.22 | hypothetical protein |
| NCLIV_061830 | 2 | 115.73 | 1.54E−03 | 2.22 | 60S acidic ribosomal protein P0 |
| NCLIV_002770 | 2 | 76.97 | 1.52E−03 | 2.18 | putative MORN repeat-containing protein |
| NCLIV_014760 | 3 | 250.75 | 4.76E−05 | 2.17 | conserved hypothetical protein |
| NCLIV_054520 | 3 | 235.53 | 1.10E−03 | 2.17 | hypothetical protein |
| NCLIV_033810 | 3 | 173.89 | 7.52E−05 | 2.16 | hypothetical protein |
| NCLIV_043330 | 2 | 91.78 | 1.01E−04 | 2.16 | hypothetical protein |
| NCLIV_000430 | 3 | 217.85 | 1.15E−03 | 2.15 | conserved hypothetical protein |
| NCLIV_030860 | 7 | 511.36 | 7.90E−04 | 2.14 | conserved hypothetical protein |
| NCLIV_048570 | 10 | 627.22 | 2.62E−05 | 2.14 | conserved hypothetical protein |
| NCLIV_004190 | 6 | 259.31 | 9.42E−05 | 2.13 | putative thioredoxin |
| NCLIV_019450 | 2 | 49.56 | 9.30E−04 | 2.13 | hypothetical protein |
| NCLIV_027160 | 8 | 468.46 | 3.85E−06 | 2.13 | conserved hypothetical protein |
| NCLIV_044600 | 2 | 123.94 | 11.10E−04 | 2.13 | conserved hypothetical protein |
| NCLIV_000300 | 5 | 211.73 | 6.11E−06 | 2.12 | conserved hypothetical protein |

TABLE 4-continued

Relative quantification (fold change) of EAE and WTE samples. Data of proteins with a fold change ≥1.5 (ANOVA, p < 0.05) in EAE vs WTE samples are shown.

| Accession number[1] | Peptides[2] | Score | Anova (p)[3] | Fold change (EAE/WTE)[4] | Description[5] |
|---|---|---|---|---|---|
| NCLIV_046830 | 2 | 99.19 | 4.45E−05 | 2.12 | putative ATP synthase |
| NCLIV_004280 | 2 | 37.7 | 8.41E−03 | 2.11 | hypothetical protein |
| NCLIV_006720 | 7 | 556.08 | 1.80E−05 | 2.1 | conserved hypothetical protein |
| NCLIV_046800 | 4 | 197.39 | 5.90E−04 | 2.1 | putative AGC kinase |
| NCLIV_051960 | 4 | 209.82 | 8.62E−06 | 2.1 | conserved hypothetical protein |
| NCLIV_010600 | 6 | 473.64 | 5.79E−03 | 2.09 | putative microneme protein MIC3 |
| NCLIV_015920 | 6 | 352.18 | 2.91E−03 | 2.09 | Histone H4, related |
| NCLIV_012830 | 4 | 272.19 | 6.90E−06 | 2.08 | putative MORN repeat-containing protein |
| NCLIV_0376 | 2 | 32.11 | 3.30E−04 | 2.08 | elongation factor Tu GTP-binding domain-containing protein |
| NCLIV_024420 | 4 | 183.64 | 5.80E−04 | 2.06 | hypothetical protein |
| NCLIV_036130 | 4 | 173.27 | 1.56E−03 | 2.06 | CBR-RSP-4 protein, related |
| NCLIV_036400 | 5 | 365.34 | 0.01 | 2.06 | unspecified product |
| NCLIV_006780 | 3 | 233.46 | 0.01 | 2.04 | conserved hypothetical protein |
| NCLIV_046940 | 3 | 43.83 | 3.62E−04 | 2.04 | putative PWWP domain-containing protein |
| NCLIV_001370 | 2 | 103.27 | 7.08E−03 | 2.03 | putative DEAD/DEAH box helicase |
| NCLIV_001300 | 9 | 523.37 | 3.91E−03 | 2.02 | putative calmodulin |
| NCLIV_015380 | 3 | 255.7 | 4.65E−05 | 2.02 | conserved hypothetical protein |
| NCLIV_038990 | 2 | 44.29 | 1.10E−03 | 2 | conserved hypothetical protein |
| NCLIV_043110 | 4 | 147.84 | 1.15E−04 | 2 | putative interferon gamma-inducible protein 30 |
| NCLIV_004750 | 2 | 163.26 | 7.15E−04 | 1.99 | putative peptidase family M48 domain-containing protein |
| NCLIV_025000 | 2 | 41.3 | 0.01 | 1.99 | hypothetical protein |
| NCLIV_041790 | 3 | 241.88 | 3.19E−03 | 1.99 | conserved hypothetical protein |
| NCLIV_058420 | 2 | 68.94 | 9.48E−05 | 1.99 | conserved hypothetical protein |
| NCLIV_015430 | 13 | 594.38 | 8.43E−07 | 1.98 | hypothetical protein |
| NCLIV_023620 | 2 | 78.88 | 7.64E−06 | 1.98 | SRS domain-containing protein |
| NCLIV_049050 | 3 | 108.7 | 5.15E−03 | 1.98 | RNA helicase-related protein required for pre-mRNA splicing, related |
| NCLIV_029420 | 6 | 506.28 | 1.63E−04 | 1.97 | putative myosin light chain TgMLC1 |
| NCLIV_010320 | 7 | 405.57 | 7.33E−04 | 1.96 | putative dihydrolipoamide branched chain transacylase, E2 subunit |
| NCLIV_006060 | 3 | 79.42 | 6.71E−06 | 1.95 | conserved hypothetical protein |
| NCLIV_032810 | 3 | 59.92 | 1.16E−04 | 1.95 | conserved hypothetical protein |
| NCLIV_004860 | 5 | 202.29 | 9.28E−04 | 1.94 | hypothetical protein |
| NCLIV_007260 | 14 | 749.04 | 7.89E−05 | 1.92 | putative p97 protein |
| NCLIV_026590 | 2 | 40.91 | 3.12E−04 | 1.91 | putative DEAD/DEAH box helicase |
| NCLIV_054540 | 2 | 133.14 | 3.03E−04 | 1.91 | RAB5C, member RAS oncogene family, related |
| NCLIV_0153 | 2 | 54.71 | 1.01E−03 | 1.9 | longevity-assurance (LAG1) domain-containing protein |
| NCLIV_030420 | 8 | 485.06 | 1.89E−03 | 1.9 | Rcn2-prov protein, related |
| NCLIV_051920 | 2 | 106.29 | 5.32E−05 | 1.9 | conserved hypothetical protein |
| NCLIV_065970 | 3 | 119 | 3.22E−03 | 1.9 | conserved hypothetical protein |
| NCLIV_026430 | 2 | 39.19 | 2.81E−03 | 1.89 | DnaJ domain containing protein, related |
| NCLIV_061160 | 9 | 988.19 | 1.83E−05 | 1.89 | putative acid phosphatase |
| NCLIV_070010 | 27 | 1401.2 | 8.35E−07 | 1.89 | hypothetical protein, conserved |
| NCLIV_036300 | 2 | 48.07 | 3.37E−04 | 1.87 | conserved hypothetical protein |
| NCLIV_057950 | 5 | 239.37 | 1.05E−05 | 1.87 | unspecified product |
| NCLIV_038320 | 3 | 214.24 | 1.33E−04 | 1.86 | unspecified product |
| NCLIV_040600 | 2 | 88.81 | 7.33E−04 | 1.86 | hypothetical protein |
| NCLIV_030820 | 2 | 124.62 | 2.59E−04 | 1.85 | conserved hypothetical protein |
| NCLIV_034990 | 3 | 223.35 | 2.73E−05 | 1.85 | Transketolase, pyridine binding domain protein, related |
| NCLIV_037520 | 3 | 143.85 | 7.57E−06 | 1.85 | conserved hypothetical protein |
| NCLIV_054120 | 10 | 556.35 | 4.79E−05 | 1.85 | unspecified product |
| NCLIV_061210 | 2 | 140.1 | 0.01 | 1.85 | conserved hypothetical protein |
| NCLIV_010650 | 2 | 39.07 | 0.01 | 1.84 | conserved hypothetical protein |
| NCLIV_026340 | 3 | 208.4 | 1.87E−04 | 1.84 | hypothetical protein |
| NCLIV_013150 | 6 | 301.32 | 1.03E−04 | 1.83 | conserved hypothetical protein |
| NCLIV_055360 | 16 | 916.46 | 3.10E−05 | 1.83 | unspecified product |

TABLE 4-continued

Relative quantification (fold change) of EAE and WTE samples. Data of proteins with a fold change ≥1.5 (ANOVA, p < 0.05) in EAE vs WTE samples are shown.

| Accession number[1] | Peptides[2] | Score | Anova (p)[3] | Fold change (EAE/WTE)[4] | Description[5] |
|---|---|---|---|---|---|
| NCLIV_066600 | 4 | 147.61 | 4.30E−05 | 1.83 | DEHA2F06798p, related |
| NCLIV_015790 | 2 | 106.09 | 2.69E−06 | 1.82 | putative fatty acyl-CoA desaturase |
| NCLIV_055730 | 3 | 174.77 | 1.32E−05 | 1.82 | hypothetical protein |
| NCLIV_067140 | 3 | 117.21 | 8.43E−03 | 1.82 | Myosin, related |
| NCLIV_007800 | 5 | 216.29 | 7.79E−06 | 1.81 | unspecified product |
| NCLIV_008850 | 6 | 335.09 | 2.83E−05 | 1.81 | conserved hypothetical protein |
| NCLIV_028110 | 2 | 74.28 | 7.52E−03 | 1.81 | putative DnaJ protein |
| NCLIV_065470 | 8 | 531.26 | 1.04E−03 | 1.81 | hypothetical protein |
| NCLIV_040650 | 2 | 45.56 | 4.62E−05 | 1.8 | conserved hypothetical protein |
| NCLIV_041830 | 2 | 36.81 | 1.26E−04 | 1.79 | os07g0543600 protein, related |
| NCLIV_050590 | 9 | 424.21 | 8.29E−05 | 1.79 | GL11864, related |
| NCLIV_051010 | 4 | 151.43 | 2.19E−09 | 1.79 | putative signal peptide peptidase domain-containing protein |
| NCLIV_058800 | 2 | 76.25 | 4.18E−03 | 1.79 | hypothetical protein |
| NCLIV_003190 | 2 | 61.78 | 1.00E−04 | 1.78 | putative mitochondrial carrier domain-containing protein |
| NCLIV_042820 | 21 | 1158.7 | 4.56E−04 | 1.78 | cDNA FLJ58099, highly similar to *Homo sapiens* clathrin, heavy polypeptide-like 1 (CLTCL1), transcript variant 1, mRNA, related |
| NCLIV_058840 | 3 | 192.43 | 6.74E−04 | 1.78 | conserved hypothetical protein |
| NCLIV_020980 | 3 | 57.96 | 5.00E−03 | 1.77 | hypothetical protein |
| NCLIV_032050 | 7 | 318.33 | 1.55E−04 | 1.77 | putative DnaJ domain-containing protein |
| NCLIV_053290 | 4 | 244.6 | 9.11E−04 | 1.77 | ORF73, related |
| NCLIV_060220 | 4 | 102.31 | 1.68E−03 | 1.77 | conserved hypothetical protein |
| NCLIV_061940 | 4 | 208.95 | 1.96E−04 | 1.77 | hypothetical protein |
| NCLIV_003650 | 4 | 227.59 | 1.92E−03 | 1.76 | hypothetical protein |
| NCLIV_006290 | 2 | 43.66 | 6.32E−03 | 1.76 | conserved hypothetical protein |
| NCLIV_016800 | 13 | 794.15 | 2.08E−06 | 1.76 | putative TCP-1/cpn60 chaperonin family protein |
| NCLIV_034130 | 3 | 137.77 | 6.72E−04 | 1.76 | hypothetical protein |
| NCLIV_052350 | 8 | 321.38 | 4.66E−06 | 1.76 | conserved hypothetical protein |
| NCLIV_054570 | 4 | 134.04 | 3.00E−03 | 1.76 | 60S ribosomal protein Ll28B 27a, related |
| NCLIV_055850 | 3 | 106.49 | 1.83E−05 | 1.76 | unspecified product |
| NCLIV_015480 | 3 | 131.95 | 6.24E−04 | 1.75 | emp24/gp25L/p24 family domain-containing, transmembrane protein |
| NCLIV_015950 | 3 | 68 | 0.02 | 1.75 | conserved hypothetical protein |
| NCLIV_030620 | 3 | 99.38 | 7.14E−04 | 1.75 | conserved hypothetical protein |
| NCLIV_041210 | 3 | 122.63 | 8.86E−03 | 1.75 | putative Ubiquinol-cytochrome c reductase complex 14 kDa protein |
| NCLIV_047860 | 9 | 600.06 | 6.18E−05 | 1.75 | hypothetical protein |
| NCLIV_054250 | 7 | 305.69 | 8.14E−04 | 1.75 | Acyl-CoA synthetase, related |
| NCLIV_058890 | 5 | 407.74 | 6.14E−04 | 1.75 | tubulin alpha chain |
| NCLIV_070060 | 3 | 185.07 | 4.45E−04 | 1.75 | RNA binding protein, putative |
| NCLIV_003580 | 5 | 244.56 | 8.92E−04 | 1.74 | conserved hypothetical protein |
| NCLIV_005620 | 7 | 408.95 | 6.98E−05 | 1.74 | putative articulin 4 |
| NCLIV_036700 | 11 | 470.43 | 5.71E−05 | 1.74 | putative M16 family peptidase |
| NCLIV_056570 | 2 | 45.41 | 5.21E−03 | 1.74 | Collagen alpha-1(III) chain (Precursor), related |
| NCLIV_059730 | 2 | 62.52 | 1.76E−04 | 1.74 | conserved hypothetical protein |
| NCLIV_008230 | 7 | 251.79 | 1.08E−05 | 1.73 | delta-aminolevulinic acid dehydratase, related |
| NCLIV_015410 | 6 | 446.94 | 7.12E−05 | 1.73 | hypothetical protein |
| NCLIV_032390 | 9 | 522.76 | 1.83E−04 | 1.73 | conserved hypothetical protein |
| NCLIV_033780 | 6 | 342.15 | 1.56E−04 | 1.73 | YALI0B05610p, related |
| NCLIV_036610 | 6 | 306.84 | 3.26E−05 | 1.73 | hypothetical protein |
| NCLIV_045300 | 2 | 47.63 | 1.55E−03 | 1.73 | Chloroquine resistance marker protein, related |
| NCLIV_049830 | 2 | 129.03 | 2.23E−03 | 1.73 | conserved hypothetical protein |
| NCLIV_055760 | 7 | 340.69 | 2.31E−05 | 1.73 | conserved hypothetical protein |
| NCLIV_058440 | 6 | 310.89 | 3.71E−04 | 1.73 | Os02g0824100 protein, related |
| NCLIV_064840 | 6 | 262.66 | 1.83E−04 | 1.73 | conserved hypothetical protein |
| NCLIV_038360 | 9 | 360.2 | 2.99E−05 | 1.72 | tsp1 domain-containing protein TSP12 (Precursor), related |
| NCLIV_043760 | 4 | 251.05 | 5.46E−04 | 1.72 | conserved hypothetical protein |
| NCLIV_052270 | 4 | 90.96 | 1.85E−04 | 1.72 | conserved hypothetical protein |
| NCLIV_013180 | 2 | 62.71 | 0.01 | 1.71 | GM04207p, related |
| NCLIV_027850 | 3 | 135.89 | 4.55E−04 | 1.71 | unspecified product |

TABLE 4-continued

Relative quantification (fold change) of EAE and WTE samples. Data of proteins with a fold change ≥1.5 (ANOVA, p < 0.05) in EAE vs WTE samples are shown.

| Accession number[1] | Peptides[2] | Score | Anova (p)[3] | Fold change (EAE/WTE)[4] | Description[5] |
|---|---|---|---|---|---|
| NCLIV_011960 | 2 | 127.88 | 5.80E−03 | 1.7 | conserved hypothetical protein |
| NCLIV_018530 | 6 | 263.87 | 2.36E−03 | 1.7 | conserved hypothetical protein |
| NCLIV_022690 | 2 | 100.72 | 2.16E−03 | 1.7 | conserved hypothetical protein |
| NCLIV_024630 | 6 | 390 | 3.28E−04 | 1.7 | putative porin |
| NCLIV_027530 | 4 | 196.22 | 1.55E−05 | 1.7 | putative lectin-domain protein |
| NCLIV_045600 | 3 | 84.95 | 1.16E−03 | 1.7 | putative glycosyl transferase, group 1 domain containing protein |
| NCLIV_001970 | 15 | 1133.5 | 1.30E−04 | 1.69 | unspecified product |
| NCLIV_011410 | 13 | 824.39 | 4.04E−03 | 1.69 | protein disulfide isomerase |
| NCLIV_014360 | 2 | 78.45 | 6.75E−03 | 1.69 | hypothetical protein |
| NCLIV_019110 | 22 | 1212.8 | 9.18E−05 | 1.69 | HSP90-like protein, related |
| NCLIV_030070 | 2 | 114.64 | 3.72E−03 | 1.69 | conserved hypothetical protein |
| NCLIV_014430 | 3 | 77.82 | 6.53E−03 | 1.68 | conserved hypothetical protein |
| NCLIV_042410 | 5 | 245.72 | 1.88E−04 | 1.68 | putative sortilin |
| NCLIV_043930 | 2 | 96.76 | 6.99E−05 | 1.68 | kelch repeat-containing proteins that is fused to a HSP90-like ATpase, related |
| NCLIV_061560 | 2 | 67.49 | 6.74E−06 | 1.68 | conserved hypothetical protein |
| NCLIV_025670 | 12 | 1112.4 | 1.34E−04 | 1.67 | ATP synthase subunit beta, related |
| NCLIV_027930 | 2 | 47.61 | 1.32E−04 | 1.67 | unspecified product |
| NCLIV_028540 | 3 | 123.41 | 2.38E−05 | 1.67 | conserved hypothetical protein |
| NCLIV_064260 | 4 | 61.54 | 3.31E−04 | 1.67 | putative WD domain-containing protein |
| NCLIV_069590 | 2 | 105.9 | 0.01 | 1.67 | hypothetical protein |
| NCLIV_013360 | 3 | 128.58 | 0.02 | 1.66 | putative plectin |
| NCLIV_040540 | 2 | 133.71 | 0.01 | 1.66 | hypothetical protein |
| NCLIV_040970 | 2 | 93.08 | 3.25E−03 | 1.66 | putative malate:quinone oxidoreductase |
| NCLIV_056670 | 4 | 271.1 | 1.33E−03 | 1.66 | conserved hypothetical protein |
| NCLIV_067010 | 6 | 337.4 | 5.00E−04 | 1.66 | Mitochondrial phosphate carrier protein, related |
| NCLIV_004140 | 3 | 235.02 | 1.89E−03 | 1.65 | hypothetical protein |
| NCLIV_028750 | 2 | 55.31 | 4.98E−03 | 1.65 | hypothetical protein |
| NCLIV_031780 | 12 | 740.6 | 4.16E−07 | 1.65 | hypothetical protein |
| NCLIV_035190 | 3 | 185.5 | 0.02 | 1.65 | conserved hypothetical protein |
| NCLIV_050470 | 6 | 222.56 | 8.11E−04 | 1.65 | hypothetical protein |
| NCLIV_051560 | 2 | 118.15 | 5.01E−03 | 1.65 | Glucose transporter 1A, related |
| NCLIV_054800 | 4 | 200.26 | 1.05E−04 | 1.65 | conserved hypothetical protein |
| NCLIV_064950 | 5 | 196.37 | 7.36E−04 | 1.65 | hypothetical protein |
| NCLIV_011700 | 2 | 150.49 | 9.37E−03 | 1.64 | unspecified product |
| NCLIV_012920 | 7 | 394 | 6.13E−04 | 1.64 | unspecified product |
| NCLIV_024030 | 3 | 155.36 | 2.48E−03 | 1.64 | conserved hypothetical protein |
| NCLIV_030890 | 5 | 178.57 | 1.95E−05 | 1.64 | putative high molecular mass nuclear antigen |
| NCLIV_032780 | 7 | 439.67 | 2.55E−06 | 1.64 | putative small heat shock protein 20 |
| NCLIV_060140 | 7 | 393.54 | 1.04E−04 | 1.64 | putative inner membrane complex protein IMC3 |
| NCLIV_065210 | 7 | 388.31 | 6.71E−05 | 1.64 | KLLA0F09449p, related |
| NCLIV_069460 | 2 | 83.29 | 3.58E−04 | 1.64 | hypothetical protein |
| NCLIV_001660 | 2 | 148.75 | 2.73E−04 | 1.63 | conserved hypothetical protein |
| NCLIV_016540 | 2 | 132.6 | 8.61E−03 | 1.63 | conserved hypothetical protein |
| NCLIV_028680 | 4 | 187.42 | 7.75E−04 | 1.63 | putative apical membrane antigen 1 |
| NCLIV_032830 | 2 | 43.37 | 0.01 | 1.63 | hypothetical protein |
| NCLIV_055490 | 29 | 1939.8 | 2.02E−04 | 1.63 | Heat shock protein 70 (Precursor), related |
| NCLIV_056560 | 2 | 36.73 | 4.05E−03 | 1.63 | putative DEAD/DEAH box helicase |
| NCLIV_066840 | 4 | 219.18 | 4.13E−04 | 1.63 | hypothetical protein |
| NCLIV_012100 | 3 | 56.68 | 0.02 | 1.62 | vacuolar protein sorting-associated protein, related |
| NCLIV_031770 | 4 | 166.07 | 4.64E−03 | 1.62 | putative membrane skeletal protein IMC1 |
| NCLIV_047810 | 3 | 206.87 | 0.01 | 1.62 | hypothetical protein |
| NCLIV_060660 | 6 | 269.94 | 4.03E−06 | 1.62 | SRS domain-containing protein |
| NCLIV_006490 | 3 | 204.73 | 5.76E−03 | 1.61 | putative myosin light chain 2 |
| NCLIV_020840 | 18 | 998.95 | 3.06E−07 | 1.61 | hypothetical protein |
| NCLIV_028090 | 6 | 354.34 | 1.40E−05 | 1.61 | conserved hypothetical protein |
| NCLIV_040440 | 2 | 122.99 | 1.81E−03 | 1.61 | conserved hypothetical protein |
| NCLIV_044200 | 2 | 91.04 | 0.01 | 1.61 | hypothetical protein |
| NCLIV_051110 | 3 | 131.75 | 1.54E−03 | 1.61 | conserved hypothetical protein |

TABLE 4-continued

Relative quantification (fold change) of EAE and WTE samples. Data of proteins with a fold change ≥1.5 (ANOVA, p < 0.05) in EAE vs WTE samples are shown.

| Accession number[1] | Peptides[2] | Score | Anova (p)[3] | Fold change (EAE/WTE)[4] | Description[5] |
|---|---|---|---|---|---|
| NCLIV_053940 | 3 | 187.83 | 9.30E−03 | 1.61 | 60S acidic ribosomal protein P2, related |
| NCLIV_055720 | 4 | 231.82 | 3.43E−06 | 1.61 | hypothetical protein |
| NCLIV_068850 | 5 | 184.16 | 2.27E−03 | 1.61 | unspecified product |
| NCLIV_019520 | 2 | 30.4 | 0.04 | 1.6 | MGC83258 protein, related |
| NCLIV_020720 | 6 | 594.33 | 5.12E−04 | 1.6 | putative microneme protein MIC11 |
| NCLIV_022950 | 4 | 201.2 | 4.01E−06 | 1.6 | putative RNA-binding protein |
| NCLIV_031670 | 8 | 379.67 | 8.17E−06 | 1.6 | conserved hypothetical protein |
| NCLIV_032110 | 6 | 285.2 | 1.74E−06 | 1.6 | conserved hypothetical protein |
| NCLIV_056300 | 5 | 152.45 | 8.84E−06 | 1.6 | conserved hypothetical protein |
| NCLIV_063370 | 4 | 116.31 | 2.63E−03 | 1.6 | conserved hypothetical protein |
| NCLIV_007770 | 8 | 438.5 | 1.69E−03 | 1.59 | putative Rhoptry kinase family protein, truncated (incomplete catalytic triad) |
| NCLIV_036570 | 2 | 87.18 | 9.76E−03 | 1.59 | YALI0D21604p, related |
| NCLIV_051840 | 3 | 167.96 | 1.25E−05 | 1.59 | hypothetical protein |
| NCLIV_052390 | 6 | 379 | 3.55E−05 | 1.59 | hypothetical protein |
| NCLIV_062890 | 2 | 95.23 | 1.39E−03 | 1.59 | hypothetical protein |
| NCLIV_003050 | 13 | 854.2 | 6.57E−05 | 1.58 | putative myosin heavy chain |
| NCLIV_004810 | 2 | 80.83 | 4.90E−04 | 1.58 | conserved hypothetical protein |
| NCLIV_021080 | 4 | 245.65 | 5.14E−05 | 1.58 | hypothetical protein |
| NCLIV_000940 | 6 | 390.99 | 2.64E−06 | 1.57 | putative Glucose-6-phosphate dehydrogenase |
| NCLIV_010730 | 5 | 337.32 | 2.89E−03 | 1.57 | srs domain-containing protein |
| NCLIV_014950 | 3 | 78.16 | 1.30E−04 | 1.57 | putative trans-2, 3-enoyl-CoA reductase |
| NCLIV_020920 | 5 | 167.95 | 7.69E−06 | 1.57 | conserved hypothetical protein |
| NCLIV_037190 | 5 | 285.66 | 9.66E−04 | 1.57 | putative glyceraldehyde-3-phosphate dehydrogenase |
| NCLIV_048380 | 2 | 64.12 | 0.03 | 1.57 | conserved hypothetical protein |
| NCLIV_049900 | 21 | 1240.8 | 1.53E−07 | 1.57 | hypothetical protein |
| NCLIV_056430 | 3 | 132.15 | 2.43E−04 | 1.57 | conserved hypothetical protein |
| NCLIV_060730 | 11 | 652.45 | 6.36E−07 | 1.57 | unspecified product |
| NCLIV_062940 | 3 | 122.12 | 7.64E−03 | 1.57 | putative pyruvate dehydrogenase |
| NCLIV_064490 | 2 | 35.78 | 2.85E−04 | 1.57 | putative phosphatidylinositol 3- and 4-kinase domain-containing protein |
| NCLIV_012230 | 2 | 81.38 | 9.61E−04 | 1.56 | Ribose-phosphate pyrophosphokinase, related |
| NCLIV_015260 | 2 | 40.6 | 1.82E−03 | 1.56 | conserved hypothetical protein |
| NCLIV_017840 | 2 | 90.2 | 1.81E−03 | 1.56 | conserved hypothetical protein |
| NCLIV_023790 | 3 | 143.66 | 1.95E−03 | 1.56 | conserved hypothetical protein |
| NCLIV_057710 | 2 | 133.02 | 2.02E−04 | 1.56 | putative ATP synthase epsilon chain |
| NCLIV_061040 | 3 | 123.17 | 0.01 | 1.56 | hypothetical protein |
| NCLIV_025600 | 2 | 68.13 | 0.03 | 1.55 | putative calmodulin |
| NCLIV_0260 | 2 | 123.25 | 5.41E−04 | 1.55 | armadillo/beta-catenin-like repeat-containing protein |
| NCLIV_033250 | 6 | 624.21 | 1.11E−04 | 1.55 | SRS domain-containing protein |
| NCLIV_048040 | 5 | 245.09 | 5.33E−04 | 1.55 | conserved hypothetical protein |
| NCLIV_059960 | 2 | 30.28 | 6.00E−03 | 1.55 | conserved hypothetical protein |
| NCLIV_066020 | 16 | 1063.3 | 9.69E−06 | 1.55 | hypothetical protein |
| NCLIV_070170 | 3 | 55.08 | 0.04 | 1.55 | hypothetical protein |
| NCLIV_012400 | 4 | 135 | 3.75E−05 | 1.53 | Articulin family protein, related |
| NCLIV_036830 | 3 | 112.62 | 0.02 | 1.53 | conserved hypothetical protein |
| NCLIV_041120 | 6 | 400.5 | 2.29E−05 | 1.53 | conserved hypothetical protein |
| NCLIV_053880 | 3 | 170.16 | 8.03E−03 | 1.53 | cDNA FLJ54097, highly similar to Succinyl-CoA ligase (ADP-forming) beta-chain, mitochondrial, related |
| NCLIV_025920 | 3 | 254.29 | 6.06E−03 | 1.52 | hypothetical protein |
| NCLIV_033680 | 5 | 158.77 | 2.01E−04 | 1.52 | Solute carrier family 25 (Mitochondrial carrier, dicarboxylate transporter), member 10, related |
| NCLIV_043270 | 3 | 247.77 | 0.01 | 1.52 | putative microneme protein MIC1 |
| NCLIV_064530 | 2 | 115.04 | 0.01 | 1.52 | Histone H2A, related |
| NCLIV_015210 | 5 | 243.99 | 6.21E−05 | 1.51 | putative ATP-dependent helicase, putaive |
| NCLIV_019830 | 3 | 119.25 | 4.18E−04 | 1.51 | hypothetical protein |
| NCLIV_025450 | 2 | 67.76 | 1.83E−03 | 1.51 | putative elongation factor Tu |

TABLE 4-continued

Relative quantification (fold change) of EAE and WTE samples. Data of proteins with a fold change ≥1.5 (ANOVA, p < 0.05) in EAE vs WTE samples are shown.

| Accession number[1] | Peptides[2] | Score | Anova (p)[3] | Fold change (EAE/WTE)[4] | Description[5] |
|---|---|---|---|---|---|
| NCLIV_048050 | 2 | 82.4 | 3.07E−03 | 1.51 | conserved hypothetical protein |
| NCLIV_049080 | 2 | 49.62 | 0.01 | 1.51 | hypothetical protein |
| NCLIV_058450 | 3 | 116.9 | 4.77E−04 | 1.51 | putative myosin regulatory light chain |
| NCLIV_003310 | 6 | 246.74 | 5.01E−04 | 1.5 | hypothetical protein |
| NCLIV_026600 | 3 | 150.82 | 2.97E−03 | 1.5 | putative 46 kDa FK506-binding nuclear protein |
| NCLIV_040040 | 2 | 70.74 | 4.20E−03 | 1.5 | grpe protein homolog, related |

[1]Accession number for the identified protein in ToxoDB database (ToxoDB-13.0_NcaninumLIV_AnnotatedProteins; 7122 sequences; Date 9 Feb. 2015) (Gajria et al., 2008, Nucleic Acids Res. 36; Database issue: D553-556).
[2]Number of identified unique peptides for each protein used for calculating protein abundance.
[3]P-value of significant differences in abundance.
[4]Fold change in protein abundance in EAE samples vs WTE samples/replicates. Fold change is calculated with average abundance determined for EAE and WTE samples/replicates.
[5]Protein description in ToxoDB database (ToxoDB-13.0_NcaninumLIV_AnnotatedProteins; 7122 sequences; Date 9 Feb. 2015) (Gajria et al., 2008, Nucleic Acids Res. 36; Database issue: D553-556).

TABLE 5

Relative quantification (fold change) of EAE and WTE samples. Data of proteins with a fold change ≥1.5 (ANOVA, p < 0.05) in WTE vs EAE samples are shown.

| Accession number[1] | Peptides[2] | Score | Anova (p)[3] | Fold change (WTE/EAE)[4] | Description[5] |
|---|---|---|---|---|---|
| NCLIV_022550 | 2 | 114.3 | 2.14E−08 | 34.11 | GK15875, related |
| NCLIV_022000 | 2 | 125.64 | 2.42E−06 | 12.5 | putative para-aminobenzoate synthase |
| NCLIV_008100 | 2 | 62.44 | 0.02 | 11.27 | putative IMPortin-alpha re-exporter |
| NCLIV_051000 | 2 | 129.9 | 7.19E−05 | 9.03 | Ethylene-inducible protein hever, related |
| NCLIV_043140 | 2 | 82.48 | 0.02 | 8.17 | putative aspartate carbamoyltransferase |
| NCLIV_038390 | 2 | 138.07 | 4.95E−08 | 8.15 | hypothetical protein |
| NCLIV_058000 | 3 | 131.22 | 5.84E−10 | 7.71 | putative alanine dehydrogenase |
| NCLIV_034160 | 2 | 110.48 | 1.06E−07 | 7.32 | Glutamine synthetase, related |
| NCLIV_001280 | 2 | 77.79 | 8.07E−10 | 7.16 | putative ribokinase |
| NCLIV_039940 | 4 | 131.44 | 6.62E−07 | 6.93 | hypothetical protein |
| NCLIV_019970 | 7 | 497.02 | 2.00E−11 | 6.62 | Peptidyl-prolyl cis-trans isomerase A, related |
| NCLIV_005860 | 3 | 142.75 | 1.03E−05 | 6.59 | IMP-specific 5'-nucleotidase, related |
| NCLIV_045650 | 6 | 502.79 | 1.90E−05 | 6.59 | unspecified product |
| NCLIV_031320 | 12 | 588.8 | 4.06E−09 | 6.42 | conserved hypothetical protein |
| NCLIV_000610 | 4 | 340.49 | 2.17E−11 | 6.24 | putative profilin family protein |
| NCLIV_028830 | 9 | 361.36 | 4.69E−09 | 6.03 | Glucose-6-phosphate isomerase, related |
| NCLIV_022080 | 2 | 92.24 | 2.19E−06 | 6.02 | hypothetical protein |
| NCLIV_028870 | 8 | 334.85 | 2.95E−08 | 5.96 | Peptidylprolyl isomerase D (Cyclophilin D), related |
| NCLIV_054700 | 9 | 524.87 | 4.43E−11 | 5.96 | putative uridine phosphorylase |
| NCLIV_050000 | 2 | 113.29 | 1.75E−06 | 5.9 | putative deoxyhypusine synthase, related |
| NCLIV_020220 | 30 | 1715.1 | 3.98E−13 | 5.89 | putative elongation factor 2 |
| NCLIV_039820 | 15 | 811.79 | 1.41E−10 | 5.88 | cDNA FLJ57348, highly similar to Homo sapiens hexokinase domain containing 1 (HKDC1), mRNA, related |
| NCLIV_053190 | 2 | 65.31 | 1.20E−06 | 5.66 | hypothetical protein |
| NCLIV_053640 | 6 | 277.83 | 2.16E−11 | 5.54 | putative peroxidoxin 2 |
| NCLIV_031730 | 2 | 121.73 | 2.50E−05 | 5.53 | putative translational activator |
| NCLIV_065910 | 7 | 456.15 | 1.29E−08 | 5.53 | conserved hypothetical protein |
| NCLIV_006620 | 2 | 48.06 | 4.61E−05 | 5.27 | trehalose-6-phosphate synthase of likely plant origin, related |
| NCLIV_024110 | 2 | 122.32 | 1.31E−08 | 5.26 | conserved hypothetical protein |
| NCLIV_055800 | 3 | 124.62 | 1.50E−06 | 5 | Serine/threonine protein phosphatase 5, related |
| NCLIV_061050 | 17 | 863.54 | 2.31E−09 | 4.99 | hypothetical protein |
| NCLIV_020310 | 4 | 123.51 | 2.88E−06 | 4.89 | putative fructose-1,6-bisphosphatase |
| NCLIV_000840 | 6 | 499.04 | 3.00E−08 | 4.88 | thioredoxin h, related |
| NCLIV_030480 | 6 | 194.11 | 2.89E−09 | 4.88 | hypothetical protein |

TABLE 5-continued

Relative quantification (fold change) of EAE and WTE samples. Data of proteins with a fold change ≥1.5 (ANOVA, p < 0.05) in WTE vs EAE samples are shown.

| Accession number[1] | Peptides[2] | Score | Anova (p)[3] | Fold change (WTE/EAE)[4] | Description[5] |
|---|---|---|---|---|---|
| NCLIV_050370 | 22 | 1574.9 | 4.21E−11 | 4.86 | unspecified product |
| NCLIV_033140 | 2 | 115.74 | 7.81E−05 | 4.83 | hypothetical protein |
| NCLIV_041180 | 2 | 89.65 | 3.32E−04 | 4.8 | 60s ribosomal protein L10, related |
| NCLIV_055070 | 5 | 197.34 | 1.37E−04 | 4.8 | Ubiquitin carboxyl-terminal hydrolase, related |
| NCLIV_066770 | 14 | 745.8 | 3.63E−10 | 4.74 | putative seryl-tRNA synthetase |
| NCLIV_002390 | 7 | 487.82 | 4.20E−08 | 4.68 | nucleoside diphosphate kinase, related |
| NCLIV_015200 | 17 | 856.25 | 3.76E−10 | 4.65 | Pyruvate kinase, related |
| NCLIV_058010 | 2 | 70.29 | 1.09E−06 | 4.62 | conserved hypothetical protein |
| NCLIV_058810 | 6 | 384.6 | 5.63E−08 | 4.62 | superoxide dismutase |
| NCLIV_042400 | 4 | 213.81 | 1.21E−07 | 4.59 | macrophage migration inhibitory factor, related |
| NCLIV_003890 | 4 | 258.5 | 1.32E−08 | 4.58 | conserved hypothetical protein |
| NCLIV_004200 | 4 | 194.55 | 6.22E−05 | 4.54 | hypothetical protein |
| NCLIV_066760 | 6 | 191.8 | 1.58E−09 | 4.54 | Translationally-controlled tumor protein, related |
| NCLIV_060760 | 12 | 595.7 | 3.51E−11 | 4.52 | putative prolyl-tRNA synthetase |
| NCLIV_038410 | 3 | 175.96 | 1.24E−09 | 4.46 | predicted hydrolases or acyltransferases, related |
| NCLIV_062630 | 8 | 472.92 | 3.63E−07 | 4.45 | Thioredoxin-dependent peroxide reductase, mitochondrial, related |
| NCLIV_006170 | 7 | 289.24 | 5.38E−07 | 4.4 | phosphoglycerate mutase, related |
| NCLIV_056020 | 9 | 412.24 | 8.38E−08 | 4.39 | hypothetical protein |
| NCLIV_032240 | 2 | 93.28 | 1.19E−07 | 4.28 | Catalase (EC 1.11.1.6), related |
| NCLIV_048670 | 3 | 113.21 | 1.05E−07 | 4.27 | cDNA FLJ55447, highly similar to ATP-citrate synthase, related |
| NCLIV_037500 | 15 | 1224.6 | 1.61E−09 | 4.25 | unspecified product |
| NCLIV_031750 | 2 | 128.55 | 1.14E−05 | 4.24 | putative importin |
| NCLIV_051530 | 5 | 370.38 | 7.09E−09 | 4.21 | hypothetical protein |
| NCLIV_065690 | 3 | 168.39 | 5.33E−05 | 4.21 | hypothetical protein |
| NCLIV_011270 | 16 | 1153 | 2.13E−09 | 4.2 | hypothetical protein |
| NCLIV_000280 | 5 | 283.96 | 3.33E−09 | 4.14 | ranbp1 domain containing protein, related |
| NCLIV_048930 | 2 | 114.64 | 2.10E−06 | 4.09 | hypothetical protein |
| NCLIV_066410 | 6 | 286.71 | 6.90E−07 | 4.07 | GG10762, related |
| NCLIV_031560 | 2 | 65.49 | 1.03E−05 | 4.06 | Arsenite-activated ATPase ArsA, related |
| NCLIV_012510 | 5 | 313.18 | 2.06E−08 | 4 | hypothetical protein |
| NCLIV_059620 | 8 | 470.24 | 8.26E−09 | 3.99 | conserved hypothetical protein |
| NCLIV_060420 | 22 | 1067.9 | 7.32E−08 | 3.98 | hypothetical protein |
| NCLIV_041940 | 8 | 569.71 | 2.76E−07 | 3.97 | glyceraldehyde 3-phosphate dehydrogenase, related |
| NCLIV_064580 | 7 | 405.65 | 3.15E−06 | 3.95 | hypothetical protein |
| NCLIV_055230 | 2 | 81.13 | 2.69E−07 | 3.92 | putative serine/threonine protein phosphatase |
| NCLIV_032320 | 5 | 217.02 | 2.43E−07 | 3.91 | hypothetical protein |
| NCLIV_041850 | 2 | 88.43 | 1.06E−05 | 3.9 | putative Hsp20/alpha crystallin domain-containing protein |
| NCLIV_020650 | 2 | 60.36 | 2.36E−04 | 3.84 | putative splicing factor 3B subunit 1 |
| NCLIV_036250 | 14 | 813.47 | 5.52E−10 | 3.83 | Asparaginyl-tRNA synthetase, related |
| NCLIV_032330 | 16 | 1105 | 8.23E−10 | 3.75 | Malate dehydrogenase (NAD) (Precursor), related |
| NCLIV_028820 | 4 | 137.19 | 9.56E−06 | 3.74 | hypothetical protein |
| NCLIV_053860 | 7 | 358.94 | 4.64E−07 | 3.74 | MGC84926 protein, related |
| NCLIV_055660 | 2 | 224.08 | 1.27E−05 | 3.74 | conserved hypothetical protein |
| NCLIV_001770 | 3 | 79.82 | 2.39E−04 | 3.69 | putative DNAK family domain containing protein |
| NCLIV_032920 | 6 | 381.9 | 4.77E−08 | 3.69 | hypothetical protein |
| NCLIV_061340 | 3 | 150.82 | 8.52E−07 | 3.68 | hypothetical protein |
| NCLIV_027230 | 9 | 407.94 | 3.46E−10 | 3.65 | Dihydropteroate synthase, related |
| NCLIV_065240 | 7 | 474.16 | 6.72E−11 | 3.64 | Fructose-1 6-biphosphatase, related |
| NCLIV_034090 | 2 | 67.7 | 1.72E−05 | 3.63 | putative kinesin heavy chain |
| NCLIV_042265 | 3 | 206.35 | 8.60E−07 | 3.63 | hypothetical protein |
| NCLIV_056140 | 22 | 1198.3 | 1.01E−10 | 3.63 | conserved hypothetical protein |
| NCLIV_048240 | 11 | 483.34 | 5.72E−09 | 3.58 | hypothetical protein |
| NCLIV_009300 | 8 | 311.88 | 2.72E−08 | 3.56 | gk17769, related |
| NCLIV_048530 | 2 | 26.41 | 4.20E−04 | 3.54 | GK19179, related |

TABLE 5-continued

Relative quantification (fold change) of EAE and WTE samples. Data of proteins with a fold change ≥1.5 (ANOVA, p < 0.05) in WTE vs EAE samples are shown.

| Accession number[1] | Peptides[2] | Score | Anova (p)[3] | Fold change (WTE/EAE)[4] | Description[5] |
|---|---|---|---|---|---|
| NCLIV_042660 | 11 | 818.58 | 2.42E−07 | 3.5 | probable cytosol aminopeptidase, related |
| NCLIV_065280 | 3 | 120.64 | 6.40E−07 | 3.5 | Proliferating cell nuclear antigen, related |
| NCLIV_016150 | 3 | 101.02 | 3.20E−06 | 3.47 | Serine--pyruvate transaminase, related |
| NCLIV_046550 | 6 | 358.56 | 4.46E−06 | 3.46 | Elongation factor 1-beta, related |
| NCLIV_012860 | 6 | 237.4 | 4.51E−06 | 3.44 | Leucyl-tRNA synthetase 2, related |
| NCLIV_055160 | 2 | 65.73 | 3.66E−05 | 3.44 | conserved hypothetical protein |
| NCLIV_019960 | 6 | 221.17 | 6.98E−07 | 3.43 | putative lysyl-tRNA synthetase |
| NCLIV_046040 | 4 | 218.71 | 2.21E−03 | 3.42 | hypothetical protein |
| NCLIV_053840 | 5 | 304.04 | 1.44E−03 | 3.42 | unspecified product |
| NCLIV_030120 | 4 | 316.47 | 2.57E−05 | 3.4 | putative importin beta-3 subunit |
| NCLIV_066250 | 9 | 552.99 | 3.47E−10 | 3.35 | unspecified product |
| NCLIV_064700 | 3 | 78.25 | 0.02 | 3.34 | Ribosomal protein L18, related |
| NCLIV_004250 | 6 | 302.25 | 1.39E−07 | 3.32 | putative nuclear RNA binding protein |
| NCLIV_007730 | 6 | 168.01 | 1.22E−05 | 3.31 | valyl-tRNAsynthetase, mitochondrial, related |
| NCLIV_000130 | 16 | 778.24 | 9.31E−12 | 3.3 | hypothetical protein |
| NCLIV_061600 | 4 | 160.38 | 5.58E−08 | 3.26 | hypothetical protein |
| NCLIV_066920 | 7 | 294.25 | 1.06E−05 | 3.26 | hypothetical protein |
| NCLIV_051620 | 3 | 117.24 | 1.81E−06 | 3.24 | putative 4'-phosphopantetheinyl transferase |
| NCLIV_029970 | 15 | 620.36 | 2.61E−08 | 3.23 | tRNA synthetase Gly, related |
| NCLIV_011830 | 5 | 299.31 | 1.03E−11 | 3.22 | conserved hypothetical protein |
| NCLIV_034270 | 2 | 55.46 | 8.56E−07 | 3.22 | putative coatomer gamma 2-subunit protein |
| NCLIV_049400 | 5 | 246.66 | 2.03E−05 | 3.21 | Serine hydroxymethyltransferase, related |
| NCLIV_010960 | 4 | 147.52 | 9.77E−09 | 3.18 | putative phosphoglucomutase |
| NCLIV_031510 | 3 | 225.69 | 2.12E−04 | 3.18 | hypothetical protein |
| NCLIV_067490 | 2 | 71.67 | 5.95E−03 | 3.16 | putative protein phosphatase 2C |
| NCLIV_042500 | 7 | 373.83 | 1.54E−08 | 3.15 | ubiquitin-activating enzyme E1, related |
| NCLIV_040880 | 36 | 2716.3 | 2.97E−09 | 3.11 | hsp90, related |
| NCLIV_052980 | 2 | 67.31 | 3.88E−05 | 3.11 | hypothetical protein |
| NCLIV_054720 | 12 | 542.24 | 5.25E−09 | 3.11 | hypothetical protein |
| NCLIV_015460 | 3 | 97.96 | 2.96E−06 | 3.08 | hypothetical protein |
| NCLIV_007860 | 13 | 479.03 | 1.84E−09 | 3.07 | hypothetical protein |
| NCLIV_041900 | 9 | 363.2 | 1.07E−07 | 3.04 | phosphoenolpyruvate carboxykinase (ATP), related |
| NCLIV_022400 | 7 | 308.98 | 7.51E−09 | 3.03 | hypothetical protein |
| NCLIV_024820 | 12 | 952.17 | 4.90E−08 | 3.03 | 14-3-3 protein homolog |
| NCLIV_045980 | 3 | 83.37 | 5.71E−07 | 3.03 | conserved hypothetical protein |
| NCLIV_005010 | 10 | 519.41 | 1.33E−08 | 3.01 | conserved hypothetical protein |
| NCLIV_045170 | 3 | 165.85 | 6.76E−08 | 3 | hypothetical protein |
| NCLIV_041690 | 3 | 133.04 | 4.55E−08 | 2.99 | ubiquitin carboxyl-terminal hydrolase, related |
| NCLIV_064310 | 11 | 550.75 | 6.29E−07 | 2.98 | GTP-binding nuclear protein Ran, related |
| NCLIV_030470 | 2 | 108.86 | 4.19E−03 | 2.96 | conserved hypothetical protein |
| NCLIV_007330 | 5 | 167.32 | 1.30E−09 | 2.95 | similar to uniprot|P15705 *Saccharomyces cerevisiae* YOR027w STI1, related |
| NCLIV_060600 | 12 | 559.96 | 2.53E−08 | 2.95 | 6-phosphogluconate dehydrogenase, decarboxylating, related |
| NCLIV_040730 | 2 | 71.65 | 1.07E−03 | 2.93 | hypothetical protein |
| NCLIV_037400 | 8 | 346.78 | 2.41E−07 | 2.92 | putative la domain-containing protein |
| NCLIV_035910 | 3 | 78.41 | 0.01 | 2.91 | hypothetical protein |
| NCLIV_066310 | 12 | 813.06 | 1.80E−08 | 2.91 | DEAD-box ATP-dependent RNA helicase 34, related |
| NCLIV_064360 | 3 | 89.7 | 6.16E−03 | 2.9 | 50S ribosomal protein L24P, related |
| NCLIV_041650 | 8 | 352.38 | 3.89E−07 | 2.89 | methionine-ARNAligase, related |
| NCLIV_025190 | 2 | 98.46 | 0.01 | 2.88 | LOC549444 protein, related |
| NCLIV_040860 | 16 | 860.14 | 6.08E−09 | 2.86 | tryptophanyl-tRNAsynthetase, related |
| NCLIV_030290 | 11 | 404.3 | 3.15E−09 | 2.85 | putative transaldolase |
| NCLIV_035310 | 4 | 186.75 | 1.69E−06 | 2.83 | putative inhibitor-1 of protein phosphatase type 2A |

TABLE 5-continued

Relative quantification (fold change) of EAE and WTE samples. Data of proteins with a fold change ≥1.5 (ANOVA, p < 0.05) in WTE vs EAE samples are shown.

| Accession number[1] | Peptides[2] | Score | Anova (p)[3] | Fold change (WTE/EAE)[4] | Description[5] |
|---|---|---|---|---|---|
| NCLIV_057250 | 2 | 80.61 | 1.52E−05 | 2.8 | conserved hypothetical protein |
| NCLIV_017040 | 3 | 100.52 | 2.74E−06 | 2.78 | Phosphofructokinase, related |
| NCLIV_029720 | 2 | 59.12 | 4.13E−04 | 2.78 | putative eukaryotic translation inflation factor |
| NCLIV_062220 | 3 | 124.62 | 3.33E−08 | 2.78 | Glutaminyl-tRNA synthetase, related |
| NCLIV_018510 | 4 | 268.14 | 1.42E−07 | 2.74 | Hydrolase Cof, related |
| NCLIV_030170 | 2 | 98.07 | 0.02 | 2.72 | hypothetical protein |
| NCLIV_060470 | 2 | 118.14 | 5.78E−04 | 2.71 | hypothetical protein |
| NCLIV_069700 | 2 | 29.2 | 3.41E−06 | 2.69 | hypothetical protein, conserved |
| NCLIV_003440 | 22 | 1396 | 7.06E−09 | 2.67 | actin, related |
| NCLIV_056110 | 6 | 249.48 | 3.42E−06 | 2.67 | putative small heat shock protein 21 |
| NCLIV_032950 | 6 | 236.19 | 1.65E−05 | 2.65 | putative deoxyuridine 5′-triphosphate nucleotidohydrolase |
| NCLIV_021260 | 2 | 73.33 | 7.25E−04 | 2.64 | hypothetical protein |
| NCLIV_024250 | 4 | 205.74 | 4.45E−04 | 2.64 | hypothetical protein |
| NCLIV_014330 | 6 | 281.13 | 2.08E−05 | 2.61 | Prolyl oligopeptidase (Precursor), related |
| NCLIV_011740 | 3 | 184.44 | 3.90E−06 | 2.59 | conserved hypothetical protein |
| NCLIV_013910 | 2 | 108.45 | 3.24E−06 | 2.59 | Pdcd4-prov protein, related |
| NCLIV_018420 | 7 | 462.63 | 2.13E−07 | 2.59 | unspecified product |
| NCLIV_011120 | 5 | 380.65 | 2.21E−05 | 2.57 | malate dehydrogenase, related |
| NCLIV_059920 | 3 | 62.95 | 2.25E−06 | 2.56 | putative eukaryotic initiation factor-2B gamma subunit |
| NCLIV_052880 | 2 | 220.99 | 4.29E−06 | 2.55 | unspecified product |
| NCLIV_009170 | 3 | 94.63 | 8.48E−08 | 2.54 | proteasome (Prosome, macropain) subunit, beta type, 1, related |
| NCLIV_020140 | 4 | 319.06 | 3.97E−08 | 2.54 | hypothetical protein |
| NCLIV_046900 | 5 | 294.71 | 5.64E−07 | 2.53 | hypothetical protein |
| NCLIV_051590 | 3 | 145.11 | 3.95E−06 | 2.52 | putative GTP binding protein |
| NCLIV_038780 | 3 | 173.32 | 7.15E−04 | 2.5 | 60s ribosomal protein L32, related |
| NCLIV_029860 | 5 | 381.32 | 1.10E−07 | 2.49 | hypothetical protein |
| NCLIV_014150 | 2 | 141.75 | 8.20E−06 | 2.44 | unspecified product |
| NCLIV_015880 | 4 | 228.69 | 3.12E−05 | 2.44 | hypothetical protein |
| NCLIV_042370 | 2 | 61.75 | 1.93E−04 | 2.42 | hypothetical protein |
| NCLIV_026180 | 4 | 163.96 | 2.10E−06 | 2.41 | hypothetical protein |
| NCLIV_034530 | 4 | 269.95 | 1.96E−04 | 2.4 | putative TCP-1/cpn60 family chaperonin |
| NCLIV_003680 | 2 | 131.44 | 3.36E−09 | 2.39 | 40s ribosomal protein S28, related |
| NCLIV_043320 | 2 | 83.69 | 1.53E−03 | 2.39 | rna recognition motif (RRM)-containing protem, related |
| NCLIV_052070 | 3 | 92.6 | 1.34E−03 | 2.38 | hypothetical protein |
| NCLIV_005770 | 4 | 210.19 | 3.59E−06 | 2.35 | hypothetical protein |
| NCLIV_031860 | 8 | 396.41 | 4.27E−04 | 2.35 | putative serine-threonine phosphatase 2C |
| NCLIV_049110 | 2 | 115.8 | 5.18E−03 | 2.35 | hypothetical protein |
| NCLIV_059340 | 5 | 187.51 | 1.38E−06 | 2.35 | conserved hypothetical protein |
| NCLIV_056360 | 2 | 82.69 | 2.20E−05 | 2.34 | Eukaryotic initiation factor, related |
| NCLIV_053580 | 9 | 645.08 | 2.38E−03 | 2.33 | 50S ribosomal protein L4P, related |
| NCLIV_065390 | 6 | 217.51 | 1.54E−06 | 2.33 | Bifunctional dihydrofolate reductase-thymidylate synthase, related |
| NCLIV_016120 | 3 | 111.44 | 6.84E−08 | 2.32 | putative proteasome subunit alpha type 4, subunit |
| NCLIV_018300 | 3 | 69.85 | 4.53E−07 | 2.31 | HIT family protein, related |
| NCLIV_051340 | 6 | 303.48 | 5.47E−06 | 2.31 | putative toxofilin |
| NCLIV_054150 | 2 | 88.03 | 2.89E−07 | 2.31 | Ubiquitin-conjugating enzyme, related |
| NCLIV_047660 | 13 | 838.79 | 2.77E−08 | 2.26 | hypothetical protein |
| NCLIV_020990 | 3 | 261.71 | 1.01E−03 | 2.25 | hypothetical protein |
| NCLIV_043400 | 3 | 133.8 | 1.90E−03 | 2.24 | proteasome subunit p58, related |
| NCLIV_031440 | 2 | 98.64 | 2.37E−05 | 2.23 | 60S ribosomal protein L38, related |
| NCLIV_055170 | 4 | 149.28 | 2.33E−05 | 2.23 | DnaJ domain containing protein, related |
| NCLIV_005550 | 7 | 351.43 | 6.94E−10 | 2.22 | hypothetical protein |
| NCLIV_019480 | 3 | 164.78 | 8.56E−06 | 2.22 | proteasome A-type and B-type domain-containing protein |

TABLE 5-continued

Relative quantification (fold change) of EAE and WTE samples. Data of proteins with a fold change ≥1.5 (ANOVA, p < 0.05) in WTE vs EAE samples are shown.

| Accession number[1] | Peptides[2] | Score | Anova (p)[3] | Fold change (WTE/EAE)[4] | Description[5] |
|---|---|---|---|---|---|
| NCLIV_062230 | 4 | 124.9 | 1.03E−08 | 2.22 | Glutaminyl-tRNA synthetase, related |
| NCLIV_065750 | 4 | 273.3 | 3.91E−05 | 2.22 | Alpha 2 subunit of 20S proteasome (ISS), related |
| NCLIV_032130 | 2 | 68.96 | 4.99E−04 | 2.19 | conserved hypothetical protein |
| NCLIV_002680 | 2 | 77.28 | 6.19E−04 | 2.18 | agap001651-PA, related |
| NCLIV_001670 | 9 | 702.68 | 2.46E−07 | 2.17 | elongation factor 1-alpha, related |
| NCLIV_051890 | 3 | 97.46 | 2.22E−03 | 2.17 | unspecified product |
| NCLIV_006150 | 2 | 66.61 | 7.86E−03 | 2.16 | tRNAbinding domain containing protein, related |
| NCLIV_061720 | 2 | 33.84 | 0.02 | 2.16 | hypothetical protein |
| NCLIV_002940 | 11 | 708.25 | 6.13E−04 | 2.15 | putative microneme protein MIC4 |
| NCLIV_011140 | 2 | 96.76 | 6.48E−04 | 2.15 | gl18351, related |
| NCLIV_027290 | 2 | 86.98 | 2.98E−04 | 2.14 | Ribosomal protein S21-maize (ISS), related |
| NCLIV_002780 | 3 | 180.07 | 3.60E−03 | 2.13 | yml024wp-like protein, related |
| NCLIV_012700 | 7 | 362.21 | 3.00E−06 | 2.13 | putative TCP-1/cpn60 family chaperonin |
| NCLIV_016000 | 2 | 39.04 | 0.04 | 2.12 | conserved hypothetical protein |
| NCLIV_052190 | 5 | 356.21 | 4.76E−07 | 2.12 | conserved hypothetical protein |
| NCLIV_068460 | 15 | 972.02 | 3.63E−05 | 2.12 | unspecified product |
| NCLIV_013780 | 4 | 144.87 | 7.26E−05 | 2.11 | hypothetical protein |
| NCLIV_034460 | 13 | 707.28 | 1.06E−06 | 2.11 | hypothetical protein |
| NCLIV_001890 | 2 | 116.47 | 1.87E−04 | 2.1 | hypothetical protein |
| NCLIV_059450 | 6 | 287.37 | 3.92E−06 | 2.1 | hypothetical protein |
| NCLIV_065590 | 13 | 690.96 | 7.09E−06 | 2.1 | putative NAD-specific glutamate dehydrogenase |
| NCLIV_067350 | 2 | 112.54 | 1.93E−06 | 2.09 | putative P-type Ca(2+)-ATPase |
| NCLIV_011210 | 8 | 404 | 1.41E−06 | 2.08 | transketolase, related |
| NCLIV_041780 | 2 | 159.54 | 4.31E−03 | 2.08 | lsu ribosomal protein L19E, related |
| NCLIV_043180 | 3 | 96.71 | 7.04E−04 | 2.08 | hypothetical protein |
| NCLIV_067180 | 6 | 212.4 | 1.20E−03 | 2.08 | Glucose-6-phosphate 1-dehydrogenase, related |
| NCLIV_020250 | 7 | 405.68 | 3.37E−05 | 2.07 | hypothetical protein |
| NCLIV_067980 | 5 | 214.79 | 1.41E−09 | 2.06 | Proteasome subunit alpha type, related |
| NCLIV_004300 | 7 | 290.38 | 4.64E−07 | 2.04 | putative dynamin-like protein |
| NCLIV_040610 | 3 | 146.35 | 4.86E−07 | 2 | virulent strain associated lipoprotein, related |
| NCLIV_045220 | 2 | 101.83 | 0.01 | 1.99 | hypothetical protein |
| NCLIV_018500 | 7 | 337.51 | 9.70E−06 | 1.99 | Fatty acyl-CoA synthetase 2, related |
| NCLIV_034470 | 3 | 150.26 | 9.96E−05 | 1.99 | hypothetical protein |
| NCLIV_003160 | 2 | 95.55 | 2.03E−06 | 1.97 | nicotinate phosphoribosyltransferase, related |
| NCLIV_038400 | 5 | 229.67 | 1.30E−04 | 1.96 | methionine aminopeptidase, related |
| NCLIV_050620 | 4 | 213.13 | 7.45E−06 | 1.96 | putative lysine decarboxylase domain-containing protein |
| NCLIV_052870 | 2 | 40.52 | 3.78E−05 | 1.96 | conserved hypothetical protein |
| NCLIV_012120 | 3 | 139.74 | 1.21E−03 | 1.95 | hypothetical protein |
| NCLIV_004710 | 3 | 101.72 | 7.24E−04 | 1.91 | hypothetical protein |
| NCLIV_001520 | 2 | 38.59 | 0.02 | 1.9 | eukaryotic translation initiation factor 3 subunit C, related |
| NCLIV_009640 | 2 | 103.9 | 2.87E−03 | 1.89 | putative choline kinase |
| NCLIV_009450 | 2 | 80.71 | 0.02 | 1.88 | 60s ribosomal protein L17, related |
| NCLIV_068630 | 2 | 71.15 | 2.74E−03 | 1.88 | conserved hypothetical protein |
| NCLIV_024090 | 8 | 286.18 | 1.10E−11 | 1.87 | putative glutamyl-tRNA synthetase |
| NCLIV_005500 | 2 | 51.48 | 3.25E−06 | 1.86 | conserved hypothetical protein |
| NCLIV_010740 | 2 | 112.89 | 3.95E−05 | 1.85 | putative kelch motif domain-containing protein |
| NCLIV_017470 | 2 | 90.71 | 1.10E−03 | 1.84 | Proteasome subunit alpha type, related |
| NCLIV_030900 | 2 | 151.03 | 1.68E−05 | 1.84 | hypothetical protein |
| NCLIV_052340 | 2 | 174.64 | 2.56E−05 | 1.84 | hypothetical protein |
| NCLIV_066870 | 2 | 135.03 | 1.68E−03 | 1.84 | hypothetical protein |
| NCLIV_018560 | 3 | 180.37 | 2.11E−05 | 1.83 | putative ras-GTPase-activating protein binding protein |

TABLE 5-continued

Relative quantification (fold change) of EAE and WTE samples. Data of proteins with a fold change ≥1.5 (ANOVA, p < 0.05) in WTE vs EAE samples are shown.

| Accession number[1] | Peptides[2] | Score | Anova (p)[3] | Fold change (WTE/EAE)[4] | Description[5] |
|---|---|---|---|---|---|
| NCLIV_024860 | 2 | 72.84 | 2.40E−06 | 1.83 | Proteasome/cyclosome repeat family protein, related |
| NCLIV_048880 | 2 | 129.53 | 1.23E−03 | 1.83 | Proteasome subunit beta type-7, related |
| NCLIV_010370 | 2 | 48.85 | 6.69E−03 | 1.82 | ubiquitin carrier protein, related |
| NCLIV_030660 | 7 | 347.29 | 4.12E−04 | 1.82 | putative TCP-1/cpn60 family chaperonin |
| NCLIV_041100 | 6 | 352.52 | 2.71E−05 | 1.82 | novel protein (Zgc: 66430), related |
| NCLIV_046690 | 3 | 94.91 | 7.51E−05 | 1.82 | VASA RNA helicase, related \| location = FR823391: 1580801-1583636(+) \| length = 769 \| sequence_SO = chromosome \| SO = protein_coding |
| NCLIV_001290 | 3 | 167.16 | 1.12E−03 | 1.81 | conserved hypothetical protein |
| NCLIV_006850 | 2 | 81.02 | 1.90E−03 | 1.81 | unspecified product |
| NCLIV_022560 | 3 | 180.8 | 4.19E−04 | 1.81 | Thermosome subunit, related |
| NCLIV_054140 | 5 | 353.27 | 1.18E−05 | 1.81 | putative adenylyl cyclase associated protein |
| NCLIV_061170 | 10 | 438.38 | 7.01E−06 | 1.81 | hypothetical protein |
| NCLIV_005900 | 3 | 144.39 | 0.01 | 1.79 | translation INITIATION FACTOR 3 SUBUNIT 9-like protein, related |
| NCLIV_064880 | 2 | 136.43 | 3.80E−03 | 1.79 | conserved hypothetical protein |
| NCLIV_016850 | 3 | 56.16 | 1.29E−03 | 1.77 | AT3G15980 protein, related |
| NCLIV_018400 | 8 | 373.4 | 2.97E−06 | 1.77 | putative TCP-1/cpn60 family chaperonin |
| NCLIV_044270 | 2 | 77.39 | 1.27E−05 | 1.77 | hypothetical protein |
| NCLIV_060380 | 5 | 255.96 | 1.09E−05 | 1.77 | hypothetical protein |
| NCLIV_046540 | 3 | 107.54 | 7.82E−06 | 1.74 | putative oligoendopeptidase F |
| NCLIV_063760 | 3 | 186.63 | 5.10E−03 | 1.74 | hypothetical protein |
| NCLIV_031550 | 14 | 679.43 | 7.38E−04 | 1.73 | unspecified product |
| NCLIV_033690 | 2 | 116.18 | 0.03 | 1.71 | hypothetical protein |
| NCLIV_045870 | 3 | 104.9 | 8.49E−03 | 1.71 | unspecified product |
| NCLIV_011980 | 7 | 212.32 | 6.26E−07 | 1.68 | calmodulin-like domain protein kinase isoenzyme gamma, related |
| NCLIV_063740 | 6 | 224.89 | 1.34E−04 | 1.68 | conserved hypothetical protein |
| NCLIV_033830 | 3 | 57.2 | 9.73E−05 | 1.67 | hypothetical protein |
| NCLIV_033950 | 17 | 1288.8 | 3.58E−08 | 1.67 | Heat shock protein 70, related |
| NCLIV_039400 | 7 | 362.33 | 4.38E−08 | 1.66 | hypothetical protein |
| NCLIV_032660 | 5 | 297.73 | 8.56E−05 | 1.63 | hypothetical protein |
| NCLIV_046050 | 13 | 733.13 | 7.16E−09 | 1.63 | hypothetical protein |
| NCLIV_059790 | 2 | 74.35 | 9.54E−03 | 1.62 | putative proteasome subunit alpha type 3 |
| NCLIV_065090 | 3 | 165.27 | 7.06E−05 | 1.6 | conserved hypothetical protein |
| NCLIV_0230 | 2 | 86.46 | 3.64E−03 | 1.56 | eukaryotic translation initiation factor 3 subunit 10 |
| NCLIV_002520 | 3 | 135.58 | 1.01E−03 | 1.55 | hypothetical protein |
| NCLIV_054200 | 2 | 179.36 | 3.50E−03 | 1.55 | Zgc: 92083, related |
| NCLIV_018290 | 2 | 103.83 | 6.60E−04 | 1.54 | Ribosomal protein S26E, related |
| NCLIV_036410 | 2 | 137.43 | 4.87E−05 | 1.54 | putative cyst matrix protein |
| NCLIV_031970 | 3 | 84.38 | 2.71E−04 | 1.53 | hypothetical protein |
| NCLIV_063380 | 2 | 41.98 | 7.17E−04 | 1.53 | hypothetical protein |
| NCLIV_050300 | 3 | 95.56 | 4.54E−06 | 1.52 | GH18750, related |
| NCLIV_001550 | 5 | 168.01 | 4.68E−03 | 1.51 | putative ribonucleoside-diphosphate reductase, large subunit |
| NCLIV_007580 | 2 | 58.9 | 2.07E−04 | 1.51 | hypothetical protein |
| NCLIV_024360 | 2 | 51.88 | 8.92E−04 | 1.51 | hypothetical protein |
| NCLIV_052510 | 2 | 153.18 | 1.69E−03 | 1.51 | hypothetical protein |

[1]Accession number for the identified protein in ToxoDB database (ToxoDB- 13.0_NcaninumLIV_AnnotatedProteins; 7122 sequences; Date 9 Feb. 2015) (Gajria et al., 2008, Nucleic Acids Res. 36; Database issue: D553-556).
[2]Number of identified unique peptides for each protein used for calculating protein abundance.
[3]P-value of significant differences in abundance.
[4]Fold change in protein abundance in WTE samples vs EAE samples/replicates. Fold change is calculated with average abundance determined for EAE and WTE samples/replicates.
[5]Protein description in ToxoDB database (ToxoDB-13.0_NcaninumLIV_AnnotatedProteins; 7122 sequences; Date 9 Feb. 2015) (Gajria et al., 2008, Nucleic Acids Res. 36; Database issue: D553-556).

4.2.3. Predicted Subcellular Localization of Identified Differentially Abundant Proteins in the EAE and WTE.

Protein predictions showed marked differences between differently abundant proteins from EAE and WTE. Protein predictions suggested that 32.9% of differentially abundant—increased EAE proteins contain a signal peptide and 25.7% contain transmembrane domains, whereas 8% of differentially abundant-increased WTE proteins contain a signal peptide and 4.6% contain transmembrane domains. These findings revealed marked differences in EAE and WTE composition assuming enrichment for membrane proteins and proteins destined towards the tachyzoite secretion pathways in the EAE.

Figure 3:
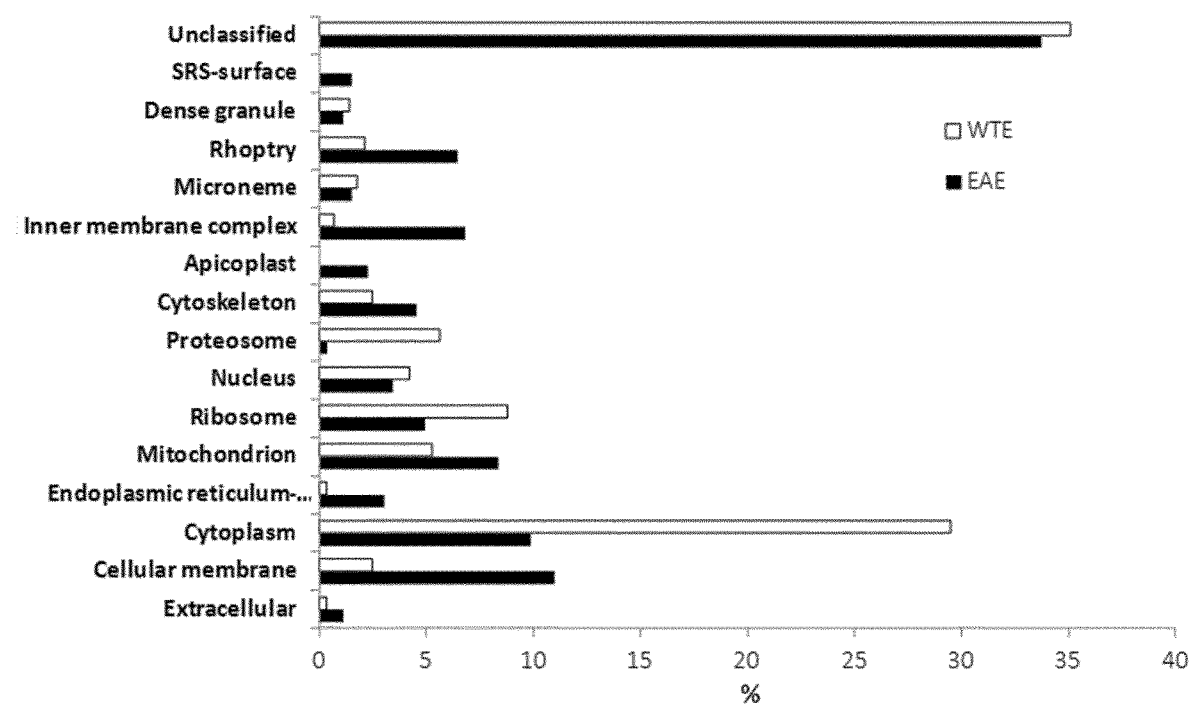
FIG. 3: Distribution of the differently abundant proteins identified by relative quantification LC-MS/MS analysis with a fold change ≥1.5 in the EAE and WTE (see legend) according to their sub-cellular localization in the tachyzoite stage. Y-axis comprise sub-cellular categories for protein distribution and X-axis shows the percentage of identified proteins assigned for each sub-cellular localization.

Classification of identified differentially abundant proteins with a fold change ≥1.5 according to sub-cellular localizations demonstred pronounced enrichment of proteins from cellular membrane, endoplasmic reticulum-Golgi, mitochondria, cytoskeleton, inner membrane complex, rhoptry, SRS-surface and apicoplast in EAE, whereas proteins from cytoplasm, ribosome and proteosome were drastically reduced in EAE or enriched in WTE (FIG. 3).

5. Immunogenic Capacity and Safety of the EAE Vaccine in the Model of Pregnant Mice The safety and immunogenicity of the EAE vaccine formulated with the saponin QuilA as adjuvant against *N. caninum* were evaluated in a pregnant mice model. Furthermore, safety and immunogenicity of the EAE vaccine were compared with a vaccine prepared with whole tachyzoite sample inactivated by lyophilisation (WTL) and QuilA as adjuvant. Safety and immunogenicity were also compared with the only commercialized vaccine against neosporosis: the NeoGuard vaccine (U.S. Pat. No. 5,707,617; WO 99/20303; Romero et al., 2004. Vet Parasitol. 123(3-4):149-59).

5.1 Material and Methods 5.1.1. Formulation of the EAE Vaccine.

EAE vaccine was formulated using the saponin Quil A as adyuvant. The volume of EAE containing the amount of required protein was quantified by Bradford method. 25 µg per dose were diluted in PBS buffer and mixed with a volume of Quil A until reaching a final proportion of 0.005% w/v for first immunization and of 0.0025% w/v for the booster in a final volume of 200 µl.

5.1.2 Formulation of the WTL Vaccine

Tachyzoite growth in cell cultures and tachyzoite purification were carried out as described in the Example 1 of the present patent using Marc 145 cell line and PD-10 (Sephadex G-25) desalting columns (GE-Healthcare, Buckinghamshire, UK). For production of lyophilized tachyzoites, purified tachyzoites were resuspended in 2% sucrose-PBS-protease inhibitor cocktail (Sigma-Aldrich) and stored at −80° C. until lyophilization. Lyophilization process was carried out in a Cryodos-80 lyophilizer (Telstar, Terrasa, Spain), with the following conditions: 0.050 mbar/−80° C./24 h, and lyophilized tachyzoites were stored at −20° C. until use. In order to evaluate loss percentage of the process, the number of tachyzoites before and after lyophilisation were compared by counting in a Neubauer chamber. A total of $5\times10^5$ lyophilized tachyzoites were directly mixed with 10 µg-0.005% w/v-(first inoculation) or 5 µg-0.0025% w/v-(booster inoculation) of Quil-A on sterile PBS in a final volume of 200 µl.

5.1.3. Experimental Design and Sampling

For the evaluation of safety and immunogenic capacities of the EAE formulated as a vaccine with Quil-A adjuvant, 8-week female BALB/c mice obtained from a suitable provider (Charles-River Laboratories) were used. Animals were placed in the animal facilities following the UE regulations in force (Community Directive 2010/63/EU) in a 12 h-light and 12 h-dark cycles controlled environment and provided with rodent feed and water ad libitum.

Mice were randomly allocated in four groups of 5 mice/group. Mice from G1, G2 and G3 were vaccinated (also referred to as "inoculated", or "immunized") with EAE vaccine, the NeoGuard vaccine and the WTL vaccine, respectively. A group of 5 non-immunized mice were inoculated with PBS as control group (G4). The dose employed in each administration was 200 µl of vaccine for each animal, containing 25 µg of protein from the EAE injected subcutaneously (sc) (G1) or 25 to 250 µg per doses of NeoGuard vaccine adjusted according to the antigen concentration range described in the corresponding document WO 99/20303 (0.1-1 mg/ml) (G2) or $5\times10^5$ purified tachyzoites (G3). The vaccination schedule consisted in two vaccinations at an interval of 21 days. All mice were observed daily in order to detect clinical signs or adverse reactions associated to the immunization. Mice were sacrificed 5 days after the last inoculation (last vaccination) and blood was collected for the evaluation of the specific immune response induced against *N. caninum* by the EAE, the NeoGuard and the WTL vaccines (immunogenicity).

5.1.4. Evaluation of the Safety of the EAE Vaccine

The safety of the EAE, NeoGuard and WTL vaccine was clinically monitored daily looking for systematic effects and local reactions, such as the presence of nodules in the inoculation site, or presence of systemic reactions due to vaccination.

5.1.5. Analysis of IgG Responses:

The humoral immune response (IgG1 and IgG2a isotypes) against the parasite was determined in sera by an indirect ELISA test, using a soluble extract of tachyzoite produced in vitro and specific monoclonal antibodies against IgG1 and IgG2a, conjugated with peroxidase enzyme (Collantes-Fernandez et al., 2006, Infect. Immun. 74:2491-2494).

5.2 Results 5.2.1. Vaccine Safety

No systemic effects attributed to the immunization were observed. Nodules in the inoculation site appeared only in a limited number of EAE (G1), NeoGuard (G2) and WTL (G3) vaccines immunized mice, which resolved a few days after the last immunization (vaccination).

5.2.2. *N. caninum*-Specifically Induced IgG Responses

Figure 4:
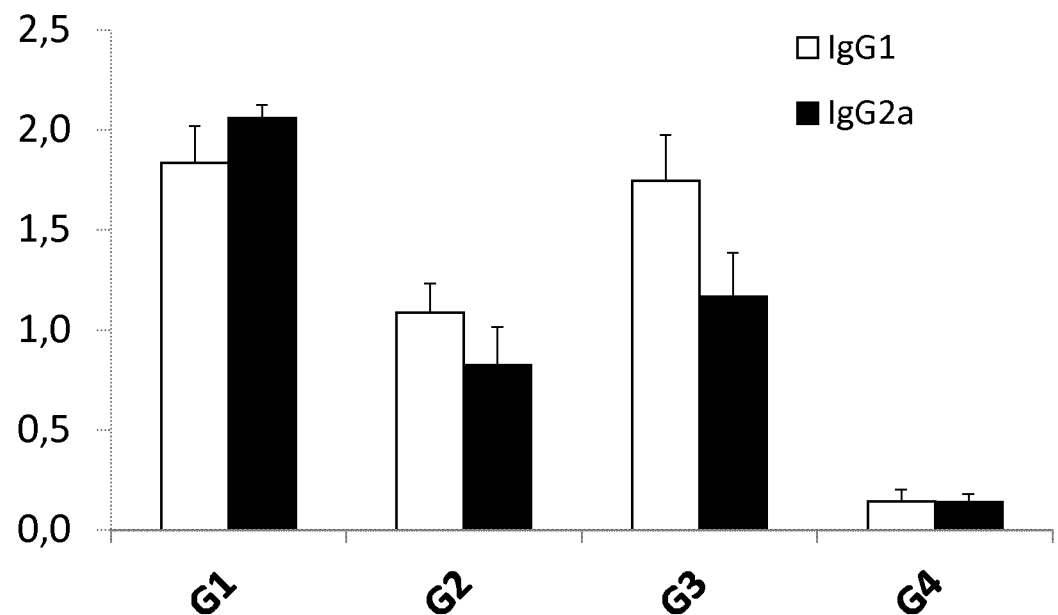
FIG. 4: IgG1 and IgG2a levels against *N. caninum* measured by ELISA in sera of mice groups after immunization with EAE vaccine (G1), NeoGuard vaccine (G2), WTL vaccine (G3) and PBS (G4). The columns represent the absorbance (optical density-OD) measurement of the immune response IgG1 (white columns) and IgG2a (black columns). The error bars represent the standard deviation.

After immunization with the EAE, NeoGuard and WTL vaccines (G1, G2 and G3), the IgG1 and IgG2a responses were evaluated in mice sera using ELISA as described above (FIG. 4). All mice inoculated with the EAE, NeoGuard and WTL vaccines showed a seroconversion according to the IgG1 and IgG2a levels reached in comparison to the control group inoculated with PBS. For both isotypes, the detected antibody levels were significantly higher with the EAE and WTL vaccines with respect to the NeoGuard vaccine (FIG. 4). The IgG1 levels induced by EAE and WTL vaccines were similar. However, the IgG2a levels detected in EAE immunized mice were significantly higher than those reached in WTL immunized mice. A higher IgG2a response than IgG1 response has been related to a Th1-type immune response and a higher activation of the cellular immunity, which is highly beneficial in the prevention and treatment of the neosporosis (Long et al., 1998, J. Parasitol. 84: 316-320).

6. Safety and Immunogenic Capacities of the EAE Vaccine in Ovine

The safety and immunogenicity against *N. caninum* of the EAE formulated as a vaccine with the saponin Quil-A as described in Example 5 was evaluated in ovine.

6.1 Material and Methods 6.1.1. Formulation of the EAE Vaccine.

EAE vaccine was formulated using the saponin Quil-A as adyuvant. For this, the volume of EAE containing the amount of required protein quantified by Bradford per dose (50 µg and 200 µg) was diluted in PBS and mixed with Quil-A until reaching a final proportion of 0.01% w/v in a final volume of 1 ml of the vaccine for both first and booster immunizations.

6.1.2. Experimental Design and Sampling

For the evaluation of safety and immunogenic capacities of the EAE formulated as a vaccine with Quil-A adjuvant in sheep, four ewes were selected from a high health status closed pure Churra breed flock. Sheep were selected to be seronegative for *T. gondii* and *N. caninum* as well as other abortifacients present in the area (*Coxiella burnetii*, *Chlamydophila abortus* and Schmallenberg disease virus). Animals were handled according the UE regulations in force (Community Directive 2010/63/EU) and provided with feed and water ad libitum. Sheep were subcutaneously inoculated twice in a 21-day interval with the EAE vaccine containing 50 μg (n=2) or 200 μg (n=2) of the EAE formulated with 0.01% w/v of the adjuvant Quil-A in a final volume of 1 ml Animals were daily monitored in order to detect clinical signs or adverse reactions associated to the immunization.

Blood samples were collected before immunization at day 0, and at days 3, 5, 7, 14 and 21 after each inoculation by jugular venipuncture in two different types of 10 ml tubes type Vacuntainer (Terumo Europe): 1) tubes without anti-coagulant and 2) heparinized tubes. Sera samples were recovered from tubes without anti-coagulant after centrifugation at 1000×g for 10 min and stored at −80° C. until serological analysis. Blood samples obtained in heparinised tubes were immediately processed in order to obtain peripheral blood mononuclear cells (PBMC) for further analyses.

6.1.3. Analytical Tests:

Determination of *N. caninum*-Specific IgG Levels in the Ovine Sera.

*N. caninum*-specific IgG antibody levels were measured using an in-house indirect enzyme-linked immunosorbent assay (ELISA) as follows: soluble antigen (prepared according to Álvarez-Garcia et al., 2003, Vet Res. 34(3):341-352) was used to coat 96-well microtitre plates (Nunc Maxisorp). For this, 100 μl/well of *N. caninum* soluble antigen containing 0.5 μg of protein (quantified by Bradford) diluted in carbonate buffer (100 mM, pH 9.6) was incubated overnight at 4° C. Subsequently, non-specific binding was blocked by adding 300 μl of bovine serum albumin diluted 3% in phosphate buffer saline (PBS) (pH 7.4) containing 0.05% Tween 20 (PBS-T). After 2 h incubation at room temperature, the plates were washed four times with PBS-T. Sera samples were diluted 1:100 in blocking solution and 100 μl of this dilution was added to each well and incubated for 1 h at 37° C. In each plate, samples of the reference positive and negative control sera were included. After four washes in PBS-T, 100 μl of horseradish peroxidase conjugate protein G (Biorad, Hercules, USA) diluted 1:5000 in PBS-T was added and incubated for 1 h at 37° C. Plates were washed as above before the addition of 100 μl per well of ABTS substrate (Sigma-Aldrich, Madrid, Spain). The reaction was stopped after 15 min at room temperature by the addition of 100 μl per well of a solution of 0.3M oxalic acid, and the optical density (OD) was read at 405 nm ($OD_{405}$). For each plate, values of the OD were converted into a relative index percent (RIPC) using the following formula RIPC=($OD_{405}$ sample–$OD_{405}$ negative control)/($OD_{405}$ positive control–$OD_{405}$ negative control)×100. A RIPC value ≥10 indicates a positive result.

Determination of IFN-γ Levels in the Ovine Sera.

IFN-γ levels in sera from immunized sheep were measured by the Bovine IFN-γ ELISA development kit (Mabtech AB, Sweden) with determinations of IFN-γ in sheep sera, following the manufacturer's recommendations. Colour reaction was developed by the addition of 3,3',5,5'-Tetramethylbenzidine substrate (TMB, Sigma-Aldrich, Spain) and after incubation for 5-10 min in the dark. Reactions were stopped by adding 2N $H_2SO_4$ (100 μl/well). Then, plates were read at 450 nm. The cytokine concentrations determined in sera were calculated by interpolation from a standard curve generated with recombinant IFN-γ provided with the kit.

Determination of *N. caninum*-Specific IFN-γ Production by Peripheral Blood Mononuclear Cells (PBMC) in Lymphoproliferation Assays.

For determination of IFN-γ production in lymphoproliferation assays, PBMC were isolated from heparinized blood samples as described previously by Wattegedera et al., 2004, Vet. Immunol Immunopathol, 102(1-2):67-76, with minor modifications: Twenty millilitres of blood from each animal were diluted 1:1 in PBS (pH 7.4) and centrifuged at 1800 rpm for 20 min at room temperature. The buffy coat was collected, diluted 1:1 in sterile PBS, layered onto a Histopaque-1077 gradient (Sigma-Aldrich) and centrifuged at 2100 rpm for 30 min. The mononuclear cells within the interface was recovered and washed three times by centrifugation at 1100 rpm for 10 min at 4° C. in Hank's buffered saline solution (HBSS). PBMC were finally re-suspended in RPMI 1640 medium (Sigma-Aldrich) supplemented with 10% foetal bovine serum, 100 μg/ml streptomycin sulphate and 100 U/ml penicillin (Sigma-Aldrich). Cells, adjusted to a concentration of $10^6$/ml with the same media after PBMC counting in a Neubauer chamber, were distributed in 48-well tissue culture plates (Nunc, Roskilde, Denmark) and cultured in triplicate with the presence of: 1) *N. caninum* soluble antigen at 5 μg/ml (Alvarez-Garcia et al., 2003, Vet. Res. 34(3):341-352), 2) Concanavalin A (ConA) at 5 μg/ml (positive control) and 3) PBS (negative control). After 72 h of culture at 37° C. in a humidified atmosphere with 5% $CO_2$, plates were centrifuged and cell-free supernatants were collected and stored at −80° C. until analysis. IFN-γ levels in supernatants were measured by the Bovine IFN-γ ELISA development kits (Mabtech AB, Sweden) as described above.

6.2 Results 6.2.1. Vaccine Safety

No systemic effects attributed to the immunization were observed. Local reactions of mild cutaneous erythema in the inoculation site were observed in three sheep after boost immunization, which disappeared 7 days after inoculation.

6.2.2. *N. caninum*-Specific IgG Responses in Sera

Figure 5:
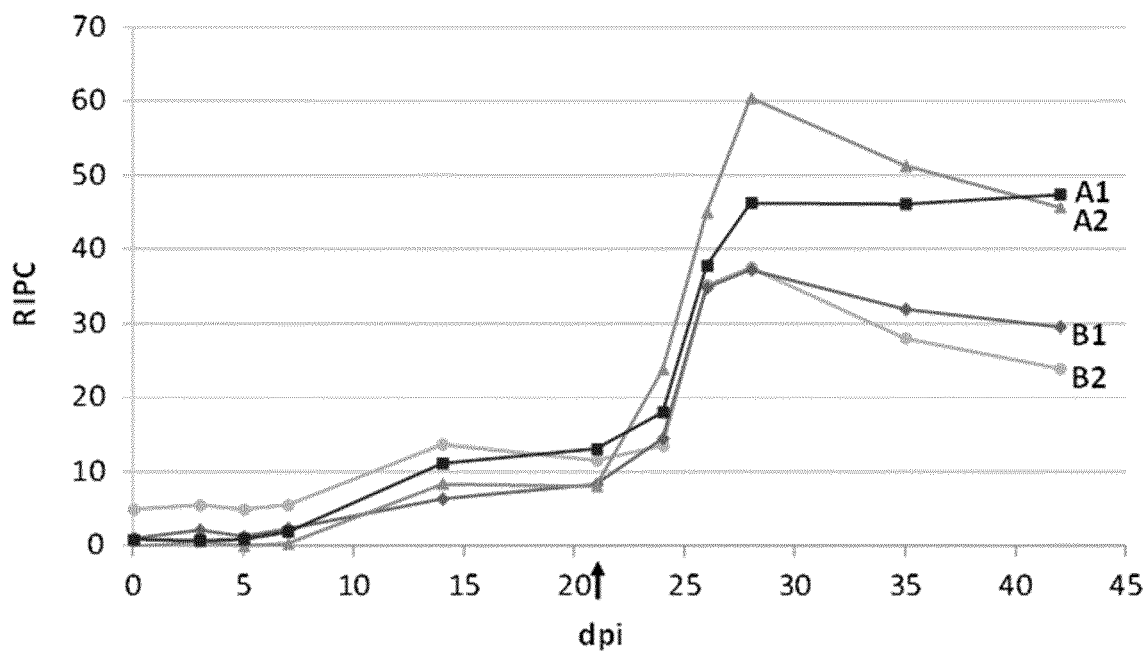
FIG. 5: Individual kinetics of IgG levels against *N. caninum* measured by ELISA in sera from sheep (*Ovis aries*) after immunization with the EAE vaccine. IgG levels measured throughout the experimental time (X-axis; days post-immunization-dpi-) are represented in the graph using the relative index percent (RIPC) value (Y-axis). Four ewes were involved in the study, two vaccinated with a low dose (50 µg) (A1 and A2) and two vaccinated with a high dose (200 µg) (B1 and B2). Ewe were vaccinated with two doses at 21 day interval. Arrow highlights day for the booster (day 21).

Kinetics of IgG responses in immunized sheep is shown in FIG. 5. The *N. caninum*-specific IgG levels increased slightly from day 14 after first immunization (dpi) in all vaccinated sheep. A significantly higher increase in IgG levels was observed in all animals after boost at 21 dpi, reaching the maximum levels at 28 dpi. These levels maintained high until the end of the experiment at 42 dpi.

6.2.3. IFN-γ Production Determined in Sera

Figure 6:
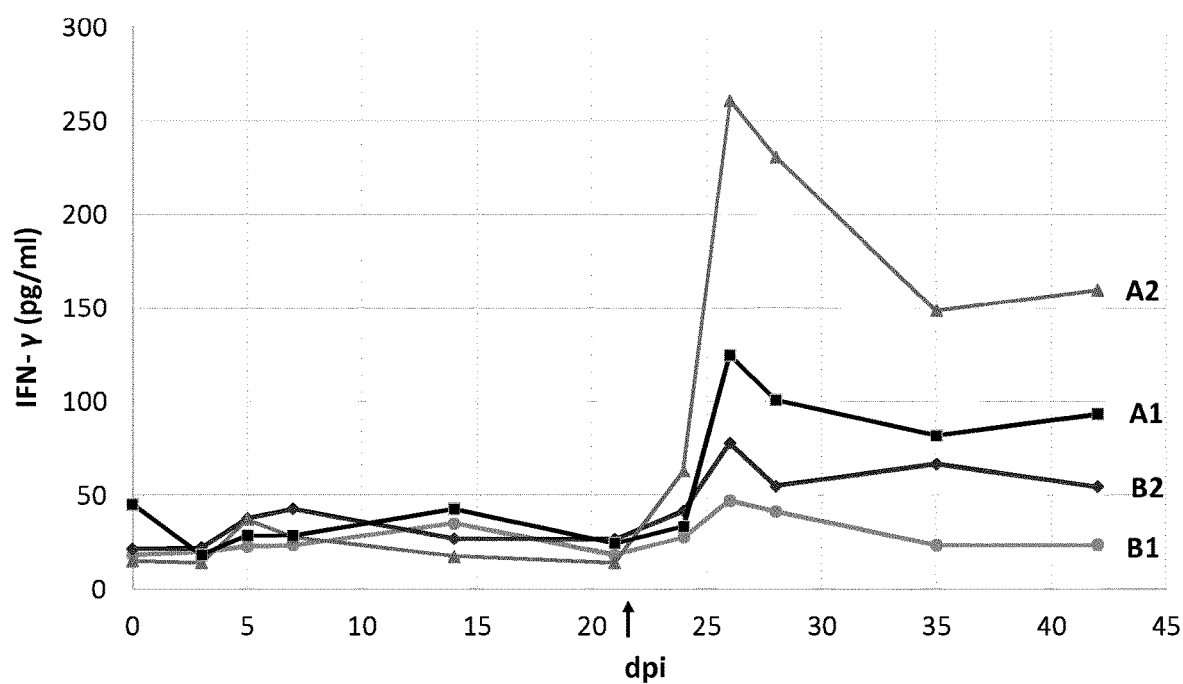
FIG. 6: Individual kinetics of IFN-γ levels measured in sera from sheep immunized with the EAE vaccine. IFN-γ levels measured throughout the experimental time (X-axis; days post-immunization-dpi) were determined by interpolation from a standard curve of recombinant IFN-γ of known concentrations in pg/ml provided in Bovine IFN-γ ELISA development kits (Mabtech AB, Sweden) (Y-axis). Four ewes were involved in the study, two vaccinated with a low dose (50 µg) (A1 and A2) and two vaccinated with a high dose (200 µg) (B1 and B2). Ewes were vaccinated with two doses at 21 day interval. Arrow highlights day for the booster (day 21).

Kinetics of IFN-γ production determined in sheep sera is shown in FIG. 6. A significant increase in IFN-γ levels in sera was detected in all animals after the boost at 21 dpi, reaching a peak at 5 days after the booster (26 dpi). A great increment was elicited in sheep immunized with the lowest dose (50 μg EAE), whereas milder increases was observed in sheep immunized with 200 μg EAE. IFN-γ levels decreased from 26 dpi in all animals, but maintained high in the sheep until the end of the assay, except for one sheep immunized with the higher dose, whose IFN-γ levels returned to basal at 42 dpi. (FIG. 6).

Figure 7:
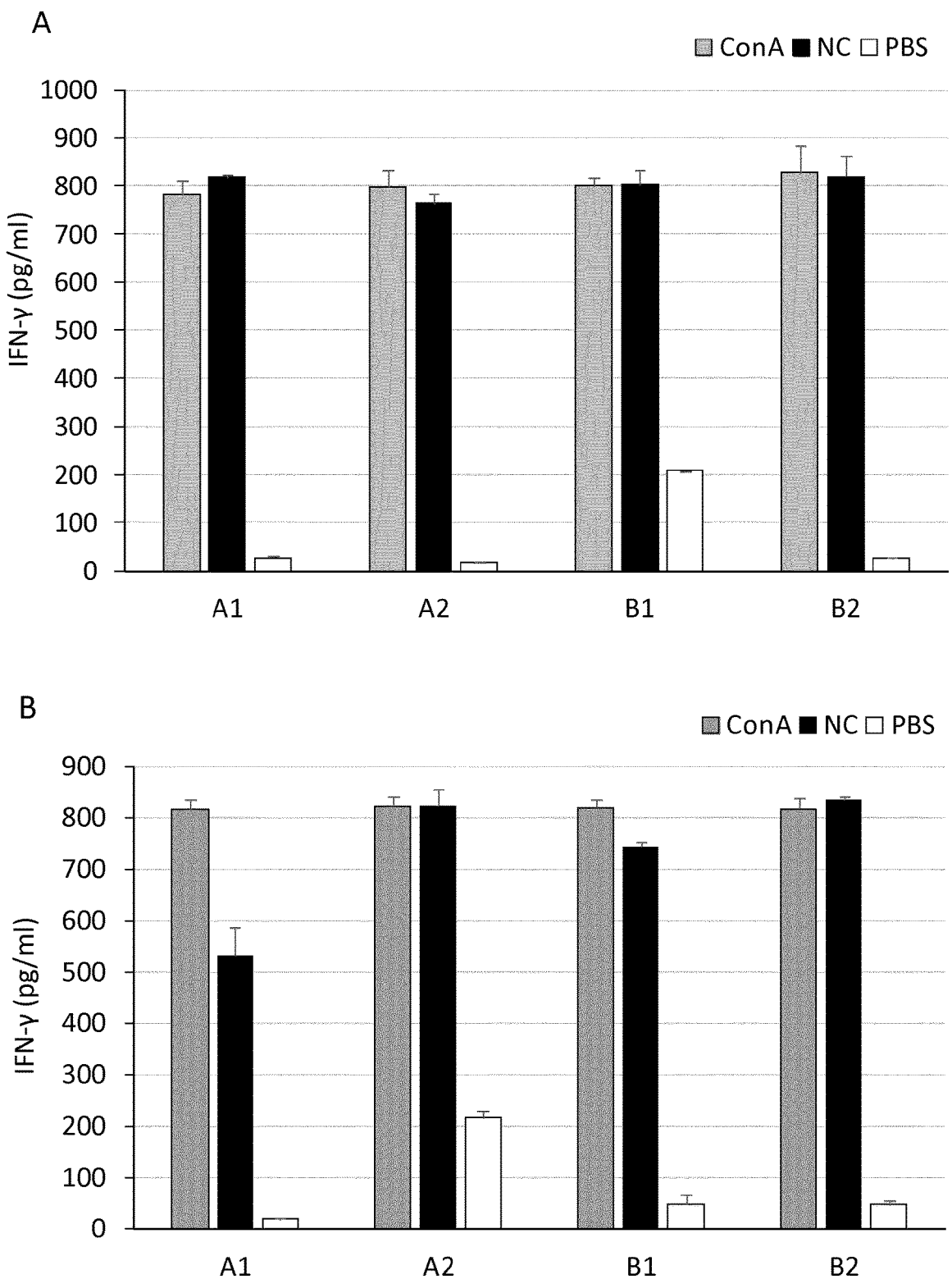
FIG. 7: Individual IFN-γ levels determined in lymphoproliferation assays at day 36 (A) and day 42 (B) after first immunization in sheep. Peripheral blood mononuclear cells (PBMC) were isolated from blood samples of ovines immunized with the EAE vaccine and stimulated in vitro with the mitogen Concanavalin A (grey columns), *N. caninum* soluble extract (black columns) or PBS (white columns) for 72 h. IFN-γ levels in culture supernatants were measured by interpolation from a standard curve of recombinant IFN-γ of known concentrations in pg/ml included in Bovine IFN-γ ELISA development kits (Mabtech AB, Sweden). Four ewes were involved in the study, two vaccinated with a low dose (50 µg) (A1 and A2) and two vaccinated with a high dose (200 µg) (B1 and B2), twice at 21 day interval. The error bars represent the standard deviation.

6.2.4. *N. caninum*-Specific IFN-γ Production Determined in Lymphoproliferation Assays Measure of IFN-γ produced by PBMC stimulated with *N. caninum* soluble antigen demonstrated a specific respond against the parasite antigens (FIG. 7A and FIG. 7B). *N. caninum* antigen stimulation of PBMCs elicited a significantly high IFN-γ secretion to the media, reaching similar or higher levels than those obtained under stimulation with the mitogen Concanavalin A. By contrast, absence or low levels of IFN-γ were detected in supernatants of PBMCs stimulated with PBS. All immunized sheep produced high IFN-γ levels, regardless of the EAE concentration used in the vaccine formulation (FIG. 7A and FIG. 7B).

7. Safety and Immunogenic Capacities of the EAE Vaccine in Cattle

The safety and immunogenicity against *N. caninum* of the EAE formulated as a vaccine with the saponin Quil-A was also evaluated in cattle.

7.1 Material and Methods

7.1.1. Formulation of the EAE Vaccine

EAE vaccine was formulated using the saponin Quil-A as adyuvant. For this, the volume of EAE containing the amount of required protein quantified by Bradford per dose (10, 50 and 100 µg) was diluted in phosphate buffer saline (PBS) (pH 7.4) and mixed with a volume of Quil-A until reaching a final proportion of 0.01% w/v in a final volume of 1 ml of the vaccine for first immunization and for booster.

7.1.2. Experimental Design and Sampling

For the evaluation of safety and immunogenic capacities of the EAE formulated as a vaccine with Quil-A adjuvant in cattle, 23 oxes were selected from a high health status closed pure Asturiana de los Valles and Asturiana de la Montaña breed herds. Oxes were selected to be seronegative for *N. caninum* Animals were handled according the UE regulations in force (Community Directive 2010/63/EU) and provided with feed and water ad libitum. Oxes were subcutaneously inoculated twice in a 21-day interval with the EAE vaccine containing 10 µg (n=6), 50 µg (n=7) or 100 µg (n=6) of the EAE formulated with 0.01% w/v of the adjuvant Quil-A in a final volume of 1 ml. In addition, 4 control animals were left un-immunized and were inoculated with the same volume of PBS Animals were daily monitored in order to detect clinical signs or adverse reactions associated to the immunization.

Blood samples were collected before immunization (day 0) and at days 7, 14 and 21 after each inoculation (first immunization and booster) by jugular venipuncture in two different types of 10 ml tubes type Vacuntainer (Terumo Europe): 1) tubes without anti-coagulant and 2) heparinized tubes. Sera samples were recovered from tubes without anti-coagulant after centrifugation at 1000×g for 10 min and stored at −80° C. until serological analysis. Blood samples obtained in heparinised tubes were immediately processed for assays of stimulation of lymphocytes in vitro.

7.1.3. Analytical Tests:

Determination of *N. caninum*-Specific IgG Levels in Bull Sera.

*N. caninum*-specific IgG antibody levels were measured using an in-house indirect enzyme-linked immunosorbent assay (ELISA) as follows: soluble antigen (prepared according to Alvarez-Garcia et al., 2003, Vet Res. 34(3):341-352) was used to coat 96-well microtitre plates (Nunc Maxisorp). For this, 100 µl/well of *N. caninum* soluble antigen containing 0.5 µg of protein (quantified by Bradford) diluted in carbonate buffer (100 mM, pH 9.6) was incubated overnight at 4° C. Subsequently, non-specific binding was blocked by adding 300 µl of bovine serum albumin diluted 1% in PBS containing 0.05% Tween 20 (PBS-T). After 2 h incubation at room temperature, the plates were washed four times with PBS-T. Sera samples were diluted 1:100 in blocking solution and 100 µl of this dilution was added to each well and incubated for 1 h at 37° C. In each plate, samples of the reference positive and negative control sera were included. After four washes in PBS-T, 100 µl of mAb anti bovine IgG horseradish peroxidase conjugate (Life Technologies—LSI Animal Health) diluted 1:12000 in PBS-T was added and incubated for 1 h at 37° C. Plates were washed as above before the addition of 100 µl per well of substrate ABTS (Sigma-Aldrich, Madrid, Spain). The reaction was stopped after 15 min incubation at room temperature by the addition of 100 µl per well of a solution of oxalic acid 0.3 M, and the optical density (OD) was read at 405 nm ($OD_{405}$). For each plate, values of the OD were converted into a relative index percent (RIPC) using the following formula RIPC=($OD_{405}$ sample−$OD_{405}$ negative control)/($OD_{405}$ positive control−$OD_{405}$ negative control)×100.

Determination of *N. caninum*-Specific IFN-γ Production in Blood Samples after Lymphocyte Stimulation In Vitro.

For determination of IFN-γ production in blood samples from animals immunized, 900 µl of blood from each animal were distributed in 24-well culture plates (Nunc, Roskilde, Denmark). A total of 6 wells were used per animal, adding a volume of 100 µl of PBS containing either: 1) *N. caninum* soluble antigen (final concentration of 5 µg/ml) (Alvarez-Garcia et al., 2003, Vet. Res. 34(3):341-352), 2) Concanavalin A (ConA, final concentration of 5 µg/ml) (positive control) and 3) PBS (negative control). All conditions were assayed by duplicate. After 24 h of culture at 37° C. in a humidified atmosphere with 5% $CO_2$, plates were centrifuged and cell-free supernatants were collected and stored at −80° C. until analysis. IFN-γ levels in supernatants were measured by the Bovine IFN-γ ELISA development kits (Mabtech AB, Sweden) as described above in Example 6.1.3.

7.2 Results

7.2.1. Vaccine Safety

No systemic effects attributed to the immunization were observed, other than a feverish reaction one day after immunization in 1/6, 3/7, and 1/6 animals from groups immunized with the high (100 µg), mid (50 µg) and low (10 µg) doses, respectively. On the other hand, one day after the booster, local reactions were observed in 2/6, 3/7, and 3/6 animals from groups immunized with the high (100 µg), mid (50 µg) and low (10 µg) doses, respectively. These consisted of mild cutaneous edema in the inoculation site which evolved turning hard and disappearing within a week.

7.2.2. *N. caninum*-Specific IgG Responses in Sera

Figure 8:
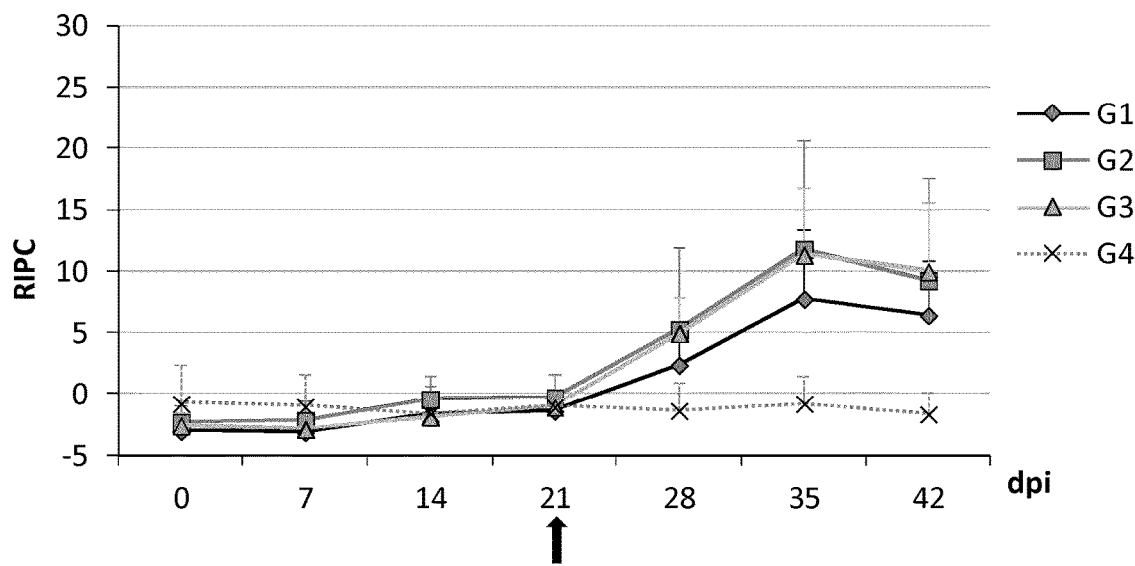
FIG. 8: Kinetics of IgG levels against *N. caninum* measured by ELISA in sera of oxes after immunization with the EAE vaccine. Average IgG levels measured throughout the experimental time (X-axis; days post-immunization-dpi-) are represented in the graph using the RIPC value (Y-axis). Twenty-three oxes were involved in the study: six vaccinated with a high dose (G1, 100 µg), seven with medium dose (G2, 50 µg), six with low dose (G3, 10 µg) and four not-immunized (G4, PBS). Oxes were vaccinated twice at 21 day interval. Arrow highlights the day of the booster (day 21). Error bars represent the standard deviation.

Kinetics of IgG responses in immunized oxes is shown in FIG. 8. The *N. caninum*-specific IgG levels increased significantly from day 28 after first immunization (dpi) (7 days after booster) in all vaccinated groups, reaching maximum values at 35 dpi. (14 post-booster). These levels maintained until the end of the experiment at 42 dpi.

Figure 9:
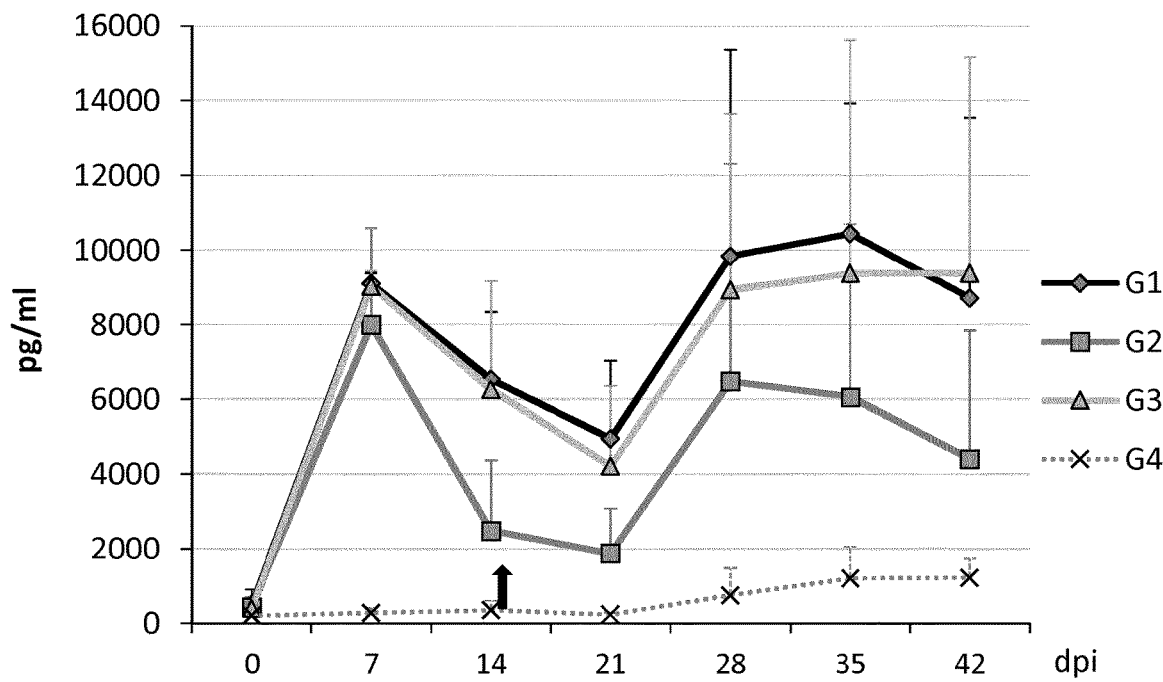
FIG. 9: Average IFN-γ levels determined by ELISA in supernatants from blood samples of oxes immunized with the EAE vaccines after in vitro stimulation with *N. caninum* soluble extract for 24 h. IFN-γ levels in culture supernatants were measured by interpolation from a standard curve of recombinant IFN-7 of known concentrations in pg/ml included in Bovine IFN-γ ELISA development kits (Mabtech AB, Sweden). Twenty-three oxes were involved in the study: six vaccinated with a high dose (G1, 100 ng), seven with medium dose (G2, 50 µg), six with low dose (G3, 10 µg) and four not-immunized (G4, PBS). Oxes were vaccinated with two doses at 21 day interval. Arrow highlights day of the booster (day 21). Error bars represent the standard deviation.

7.2.3. *N. caninum*-Specific IFN-γ Production after Lymphocyte Stimulation In Vitro Measurement of IFN-γ produced after stimulation with *N. caninum* soluble antigen demonstrated a specific response against the parasite antigens from day 7 post-immunization onwards, peaking at days 7 and 28 (1 week after first immunization and booster, respectively) (FIG. 9). *N. caninum* antigen stimulation elicited a significantly high IFN-γ secretion, reaching similar or higher levels than those obtained under stimulation with the mitogen ConA. By contrast, absence or low levels of IFN-γ were detected in supernatants of cells stimulated with PBS. All immunized oxes produced high IFN-γ levels, regardless of the EAE concentration used in the vaccine formulation, whereas *N. caninum*-specific secretion of IFN-γ was not detected in blood samples from PBS-inoculated oxes (FIG. 9).

8. Efficacy of the EAE Vaccine in the Model of Pregnant Mice

The efficacy of the EAE formulated as a vaccine with the saponin Quil-A against the infection by *N. caninum* was evaluated in a pregnant mice model.

8.1. Material and Methods 8.1.1. Experimental Design and Sampling

As described in Example 5, female mice from BALB/c lineage of 8 weeks of age provided by a suitable trader (Charles-River Laboratories) were used for the vaccine trial with the EAE vaccine Animals were allocated in the animal facilities following the UE regulations in force (Community Directive 2010/63/EU) in a 12 h-light and 12 h-dark cycle controlled environment and provided with rodent feed and water ad libitum.

Groups included in the efficacy test are detailed in Table 6. Mice were randomly separated in groups of 19-27 mice/group. A group of 10 non-immunized and non-challenged mice was reserved as sentinel group of exogenous infection for bioassay (G5). As described in Example 5, the EAE vaccine efficacy was compared with NeoGuard and WTL vaccines. The dose employed in each administration was 200 µl of vaccine for each animal, which contains 25 µg of EAE, injected subcutaneously (sc) (G1) or 25 to 250 µg per doses of NeoGuard vaccine (WO 99/20303) (G2) or $5 \times 10^5$ purified tachyzoites (G3). The vaccination schedule consisted in two vaccinations separated by 21 day-interval. Control challenged and non-challenged non-immunized groups were inoculated with the same volume of PBS (G4 and G5). The mating took place 20 days after the last immunization. For the mating, the ovulation of the females was stimulated and synchronized by the Whitten effect for 72 hours (Whitten, 1957, Nature 4599:1436). Afterwards, 2 females and 1 male were housed together for 4 days. The first day that the two females and the male were housed together was considered as the "day 0 of the pregnancy" (day 0 of the gestational period). In the middle of the pregnancy period (days 7 to 10 of pregnancy) the challenge was performed with $2 \times 10^6$ tachyzoites of the *N. caninum* Nc-Liv isolate, subcutaneously inoculated to all mice with the exception of the those belonging to the sentinel group (G5). The pregnancy diagnosis was performed through the determination of the animal weight at 17-18 day of pregnancy. Females diagnosed as pregnant were individually housed. All mice were allowed to give birth, and pups were kept with dams until day 30 post-partum (pp), when both dams and pups were sacrificed. All mice were observed daily in order to detect clinical signs or adverse reactions associated to the immunization or parasite infection. The occurrence of nervous clinical signs compatible with the disease (walking in circles, activity decrease or hind limb paralysis) led to the sacrifice of those animals.

TABLE 6

Distribution of the groups for the evaluation of the efficacy of the vaccine

| Group | Vaccine | Vaccine dosage (µg/doses/mice) | Challenge (Nc-Liv) |
|---|---|---|---|
| G1 | EAE-QuilA | 25 µg[a] | $2 \times 10^6$ |
| G2 | NEOGUARD ® | 25-25 µg[b] | $2 \times 10^6$ |
| G3 | WTL-QuilA | $5 \times 10^5$ lyo-tachy[c] | $2 \times 10^6$ |
| G4 | PBS | 0 | $2 \times 10^6$ |
| G5 | PBS | 0 | 0 |

[a]Amount of EAE equivalent to 25 µg of protein by Bradford;
[b]Amount of protein per doses of the NeoGuard vaccine adjusted according to the concentration range of the antigen as it appears in the corresponding document WO 99/20303 (0.1-1 mg/ml);
[c]Amount of lyophilized tachyzoites per doses of the WTL vaccine.

Blood samples were collected from dams by cardiac puncture at necropsy, and the recovered sera were preserved at −80° C. for ELISA analysis. Brains from pups and dams were also collected under aseptic conditions and were frozen at −80° C. until DNA extraction and PCR analysis.

Litter size was considered as the number of pups delivered per dam. Early pup mortality was defined as the number of full-term dead pups at the time of birth plus those dead from birth to day 2 postpartum. Pup mortality was considered to be the number of pups sacrificed from days 2 to 30 postpartum. The vertical transmission rate was determined in this study by the presence of the parasite DNA in the brain of pups detected by nested-PCR.

8.1.2. Analytic Tests:

Characterization of the Humoral Immune Response:

The humoral immune response (IgG1 and IgG2a isotypes) was determined in mice sera using indirect ELISA test as described above in Example 5.1.5. (Collantes-Fernandez et al, 2006, Infect. Immun. 2006. 74:2491-4).

Parasite Detection by PCR:

DNA was isolated from 20-50 mg of mice brain using the Maxwell® 16 Mouse Tail DNA Purification Kit system following the manufacturer's instructions (Promega). In order to detect the presence of the parasite a nested-PCR on the ITS-1 region of *N. caninum* was employed, as described in Regidor-Cerrillo et al., 2010, Vet. Res., 41:52 using *N. caninum* specific primers described by Buxton et al., 1998 (Buxton et al., 1998, J Comp Pathol. 118: 267-279).

8.1.3. Evaluation of the Safety and Efficacy of the EAE Vaccine

The safety of the vaccine was evaluated by the daily examination of the animals as described in Example 5, checking whether local reactions took place, such as the presence of nodules in the inoculation site, or systemic reactions due to vaccination.

The efficacy of the vaccine was evaluated in comparison with the non-immunized and challenged control group (G4) according to the following parameters:

Morbidity and mortality: Pregnant mice and pups were examined daily for clinical signs compatible with neosporosis (delayed hair coat development, rough hair coat, and neurological signs). The following information was recorded: 1) morbidity; by the presence or absence of clinical signs, the date that those signs appeared, number of affected animals, and kind of clinical signs. When injuries in the site of parasite inoculation were observed, the number of affected animals and severity of lesion was also recorded. 2) Mortality; the occurrence of nervous clinical signs compatible with the disease leads to the sacrifice of those animals. The frequency (%) of mice with clinical signs and mice that succumbed to infection was evaluated and compared among groups. Based on mortality data, the average survival time was also determined for each group.

Presence of N. caninum by nested PCR. The frequency (%) of parasite detection in brain of dams, as target organ of persistency of the infection, and brain of pups, as target organ for the transmission of the parasites, was also evaluated.

Pregnancy rate, early pup mortality and litter size were also compared.

8.1.5. Statistical Analysis

Differences in pregnancy rate, early pup mortality, pup mortality on day 30 after birth, the frequency of parasite detection in the dams and vertical transmission was performed by applying the statistic Chi-square test or the F-test (Fisher) through contingency tables 2×2 (Ludbrook & Dudley, 1994, Aust. N. Z. J. Surg. 64:780-787). In addition, pup mortality was analysed by the Kaplan-Meier survival method to estimate the percentage of surviving animals at each time point (days after birth). To compare the survival curves between mice groups, the log-rank statistical test was applied (Bland & Altman, 1998, BMJ 7172:1572; Bland & Altman, 2004, BMJ 7447:1073). The statistical confidence level was $p<0.05$ for all tests. When statistically significant differences were detected, all groups were analyzed in pairwise comparisons, applying a correction factor $p<0.05/k$, wherein k is the number of groups (Morrison, 2002, Int. J. Parasitol. 32, 1065-1070).

With regard to the optical density values of IgG1 and IgG2a, the differences among groups were analysed by the unifactorial ANOVA parametric test. When statistically significant differences were observed ($p<0.05$), groups were pairwise compared following the Tukey test. By using the Dunnett parametric test, all groups were compared with the non-vaccinated and non-challenged group (Morrison, 2002, Int. J. Parasitol. 32, 1065-1070).

8.2. Results 8.2.1. Vaccine Safety

No systemic effects attributed to the immunization were observed as described in Example 5. Nodules in the inoculation site appeared only in a limited number of vaccinated mice as described in Example 5, and disappeared a few days after the immunization.

8.2.2. Vaccine Efficacy

After the challenge, injuries in the site of inoculation in all mice belonging to the non-immunized and challenged group (G4) were observed, which were resolved by the following 2 weeks after the challenge. Only mild clinical signs related with the infection (rough hair coat and mild rounded back) were observed in some mice from this group G4. None of the immunized mice developed injuries in the inoculation site or clinical neosporosis signs.

Table 7 summarizes the data relative to pregnancy rate, litter size, early pup mortality (stillborn and dead up to day 2 pp) and pup mortality (2-30 day pp) obtained in the vaccine trial.

The number of pregnant females was considerably low in the G2 group vaccinated with NeoGuard vaccine (3 animals), which was significantly lower in comparison to the remaining groups ($p<0.007$, F-test). Similarly, the group immunized with the commercial vaccine (G2) showed the smallest litter size, although no significant differences were observed. With regard to the early pup mortality (up to day 2 pp), the highest number was observed in group G4, non-immunized and challenged, although no differences between the vaccinated groups and the non-challenged group G5 were found.

Concerning the late pup mortality (days 2-30 pp), a significant decrease in the mortality rate in the mice inoculated with the EAE, NeoGuard and WTL vaccines (groups G1, G2 and G3) was observed in comparison with the non-immunized and challenged group G4 ($p<0.0001$, F-test). The highest protection rate was achieved with the EAE extract. No significant differences were observed when comparing the EAE vaccine (G1) immunized group and the sentinel group (non-challenged, G5) ($p=0.39$). Moreover, the late pup mortality was significantly lower in mice immunized with the EAE vaccine (G1) than in mice immunized with the WTL vaccine (G3) ($p<0.0001$, F-test). The protection against mortality was also partial in the group vaccinated with NeoGuard (G2), which showed a higher mortality rate than the non-challenged control group G5 ($p=0.03$).

TABLE 7

Data of evaluation of the efficacy of the vaccine of the invention against neosporosis: Pregnancy rate, Litter size, Early pup mortality and Pup mortality at day 30 after birth

| Group | Vaccine | Pregnancy rate | Litter size | Early mortality | Mortality (2-30 days after birth) |
|---|---|---|---|---|---|
| G1 | EAE-QuilA | 17/20 (85%) | 6.8 ± 1.8 | 14/116 (12.1%) | 12/102 (11.8%) |
| G2 | NeoGuard | 3/27 (11.1%) | 4.7 ± 0.6 | 1/14 (7.1%) | 4/13 (30.8%) |
| G3 | WTL-QuilA | 10/20 (50%) | 7.70 ± 1.49 | 11/77 (14.3%) | 30/66 (45.5%) |
| G4 | PBS | 14/19 (73.7%) | 5.57 ± 1.99 | 24/95 (25.3%) | 70/71 (98.6%) |
| G5 | PBS | 8/10 (80%) | 7 ± 2.7 | 6/56 (10.7%) | 3/50 (6%) |

Figure 10:
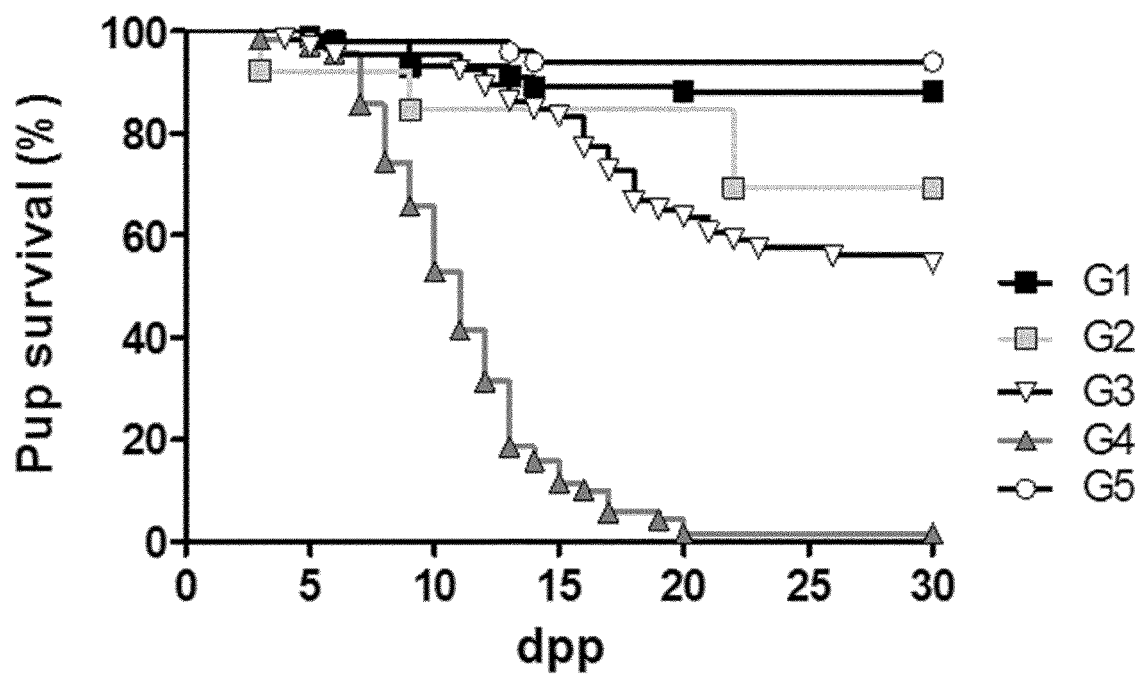
FIG. 10: Kaplan-Meier survival curves for pups born from dams vaccinated with EAE (G1), NeoGuard (G2), WTL (G3) and PBS (G4) before mating and challenged on day 7 of pregnancy with $2 \times 10^6$ tachyzoites of *N. caninum* Nc-Liverpool (Nc-Liv) isolate and the non-vaccinated non-challenged (G5) group. Y-axis represents % of pup survival throughout the experimental time for each group and X-axis days post-partum (dpp).

The comparison of survival curves, as shown in FIG. 10, confirmed the lower protection achieved by the WTL, followed by NeoGuard vaccine, in comparison with EAE vaccine. The average survival time was significantly lower in these groups (G2 and G3) in comparison with the average survival time of sentinel non-challenged G5 ($p=0.01$; Log-rank test). By contrast, no significant differences were observed in the average survival time between group G1 (EAE vaccine of the present invention) and the non-challenged group G5 ($p=0.2654$). Furthermore, the average survival time of pup from mice vaccinated with EAE vaccine were significantly higher than survival time of pup from mice vaccinated with WTL vaccine ($p<0.0001$; Log-rank test).

Table 8 summarizes the parasite detection data using PCR in the brain tissues from the dams and pups.

Parasite detection by PCR in the dam brain demonstrated a lower parasite frequency in brains of dams vaccinated with the EAE, NeoGuard and WTL vaccines in comparison with the challenged group G4, although variation only was significant for EAE and WTL immunized groups (G1 and G3) ($p<0.006$). As for the parasite detection by PCR in the dam brain, the lowest infection rate in pups or vertical transmission was detected in the group vaccinated with the EAE vaccine in comparison with the challenged group G4 (p<0.0001). Similarly, the percentage of detection in the pups from EAE vaccinated group was significantly lower than the vertical transmission rate detected in pups vaccinated with WTL vaccine (p<0.0001).

TABLE 8

Data of the evaluation of the efficacy of the vaccine of the invention against neosporosis: Parasite detection using PCR in brain tissues from dams and pups.

| Grup | Vaccine | Infection persistency | Vertical transmission |
|---|---|---|---|
| G1 | EAE-QuilA | 4/17 (24%) | 13/102 (13%) |
| G2 | NeoGuard | 1/3 (33.3%) | 4/8 (50%) |
| G3 | WTL-QuilA | 5/10 (50%) | 33/66 (50%) |
| G4 | PBS | 14/14 (100) | 30/30 (100%) |
| G5 | PBS | 0/8 (0%) | 0/50 (0%) |

8.2.3. Immune Responses

Figure 11:
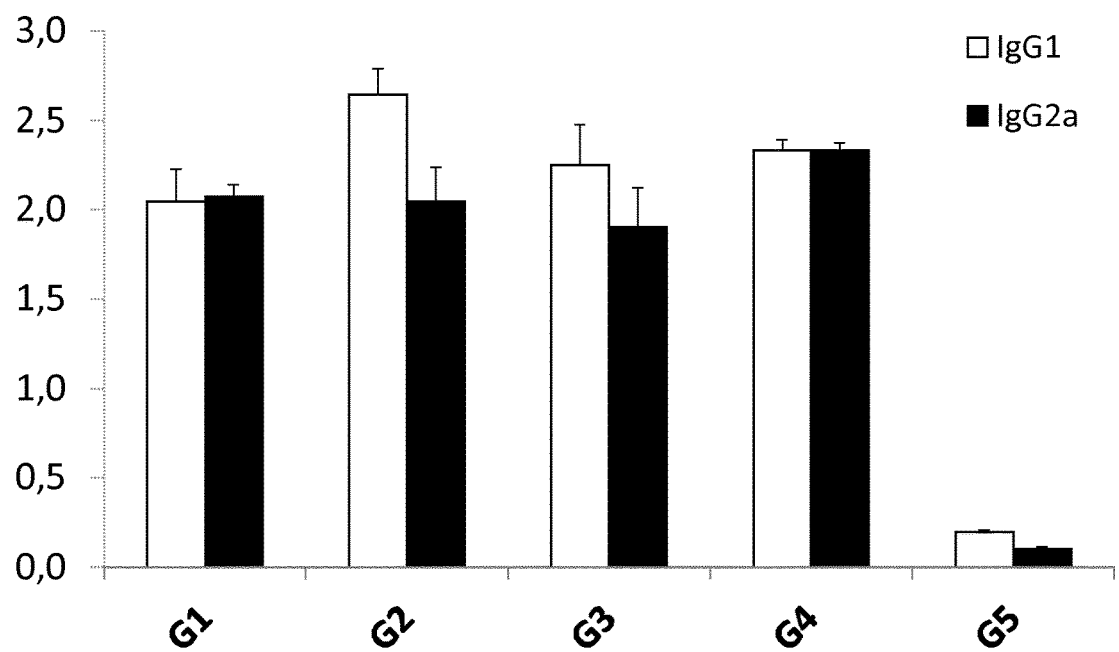
FIG. 11: IgG1 and IgG2a levels against *N. caninum* measured by ELISA in sera of mice groups vaccinated with EAE (G1), NeoGuard (G2), WTL (G3) and PBS (G4) before mating and challenged on day 7 of pregnancy with $2 \times 10^6$ tachyzoites of *N. caninum* Nc-Liv isolate and the non-vaccinated non-challenged (G5) group. The columns represent the O.D measurement of the immune response IgG1 (white columns) and IgG2a (black columns). The error bars represent the standard deviation.

All challenged mice were seropositive for IgG1 and IgG2a isotypes at day 30 post-partum, as shown in FIG. 11. The comparative analysis of the humoral immune response showed that the determined IgG1 levels in the group of mice immunized with the EAE vaccine (G1) were significantly lower than those determined for the remaining challenged groups (G2, G3 and G4), suggesting a better control of N. caninum infection in those mice immunized with the EAE vaccine. The group of mice immunized with the WTL vaccine, followed by the challenged control group G4 also showed a lower IgG1 response in comparison to the NeoGuard vaccinated group (G2), which showed the highest levels (p<0.05). A significant reduction of IgG2a levels was also observed in the group of mice immunized with the EAE, NeoGuard and WTL vaccines (G1, G2 and G3) when compared to the non-immunized and challenged group (G4) (FIG. 11).

These results demonstrate a high efficacy of the EAE vaccine against transplacental transmission and pup mortality caused by N. caninum in a pregnant mouse model compared to the NeoGuard vaccine and a vaccine based on whole tachyzoite formulated with Quil A.

Summary of Sequences

| Accession number | SEQ ID NO |
|---|---|
| NCLIV_070010 | 1 |
| NCLIV_019110 | 2 |
| NCLIV_042820 | 3 |
| NCLIV_048590 | 4 |
| NCLIV_049900 | 5 |
| NCLIV_055360 | 6 |
| NCLIV_055490 | 7 |
| NCLIV_064620 | 8 |
| NCLIV_033950 | 9 |
| NCLIV_011410 | 10 |
| NCLIV_046170 | 11 |
| NCLIV_040880 | 12 |
| NCLIV_059600 | 13 |
| NCLIV_014060 | 14 |
| NCLIV_001670 | 15 |
| NCLIV_066840 | 16 |
| NCLIV_066020 | 17 |
| NCLIV_001970 | 18 |
| NCLIV_003050 | 19 |
| NCLIV_046050 | 20 |
| NCLIV_020840 | 21 |
| NCLIV_031550 | 22 |
| NCLIV_019770 | 23 |
| NCLIV_007260 | 24 |
| NCLIV_015430 | 25 |
| NCLIV_067140 | 26 |
| NCLIV_039100 | 27 |
| NCLIV_002940 | 28 |
| NCLIV_045800 | 29 |
| NCLIV_047860 | 30 |
| NCLIV_031780 | 31 |
| NCLIV_046260 | 32 |
| NCLIV_003440 | 33 |
| NCLIV_015440 | 34 |
| NCLIV_032660 | 35 |
| NCLIV_005150 | 36 |
| NCLIV_058890 | 37 |
| NCLIV_017370 | 38 |
| NCLIV_025670 | 39 |
| NCLIV_007800 | 40 |
| NCLIV_034460 | 41 |
| NCLIV_043270 | 42 |
| NCLIV_033230 | 43 |
| NCLIV_065210 | 44 |
| NCLIV_010600 | 45 |
| NCLIV_060730 | 46 |
| NCLIV_025240 | 47 |
| NCLIV_038360 | 48 |
| NCLIV_016800 | 49 |
| NCLIV_068400 | 50 |
| NCLIV_068460 | 51 |
| NCLIV_050370 | 52 |
| NCLIV_053580 | 53 |
| NCLIV_024820 | 54 |
| NCLIV_0230 | 55 |
| NCLIV_001520 | 56 |
| NCLIV_039400 | 57 |
| NCLIV_048570 | 58 |
| NCLIV_025920 | 59 |
| NCLIV_001300 | 60 |
| NCLIV_068920 | 61 |
| NCLIV_036700 | 62 |
| NCLIV_002520 | 63 |
| NCLIV_045585 | 64 |
| NCLIV_061170 | 65 |
| NCLIV_025190 | 66 |
| NCLIV_011980 | 67 |
| NCLIV_034130 | 68 |
| NCLIV_012920 | 69 |
| NCLIV_032430 | 70 |
| NCLIV_021050 | 71 |
| NCLIV_058440 | 72 |
| NCLIV_030050 | 73 |
| NCLIV_008850 | 74 |
| NCLIV_000010 | 75 |
| NCLIV_004190 | 76 |
| NCLIV_020220 | 77 |
| NCLIV_061160 | 78 |
| NCLIV_017500 | 79 |
| NCLIV_015380 | 80 |
| NCLIV_050590 | 81 |
| NCLIV_024740 | 82 |
| NCLIV_0341 | 83 |
| NCLIV_031670 | 84 |
| NCLIV_030940 | 85 |
| NCLIV_065470 | 86 |
| NCLIV_015920 | 87 |
| NCLIV_010730 | 88 |
| NCLIV_033690 | 89 |
| NCLIV_068850 | 90 |
| NCLIV_032390 | 91 |
| NCLIV_021080 | 92 |
| NCLIV_015880 | 93 |
| NCLIV_048460 | 94 |
| NCLIV_010320 | 95 |
| NCLIV_042410 | 96 |
| NCLIV_015410 | 97 |
| NCLIV_037190 | 98 |
| NCLIV_060820 | 99 |
| NCLIV_000390 | 100 |
| NCLIV_050470 | 101 |

| Accession number | SEQ ID NO |
|---|---|
| NCLIV_012120 | 102 |
| NCLIV_041740 | 103 |
| NCLIV_016850 | 104 |
| NCLIV_031970 | 105 |
| NCLIV_041180 | 106 |
| NCLIV_030420 | 107 |
| NCLIV_010720 | 108 |
| NCLIV_036830 | 109 |
| NCLIV_045460 | 110 |
| NCLIV_024880 | 111 |
| NCLIV_062720 | 112 |
| NCLIV_025160 | 113 |
| NCLIV_054140 | 114 |
| NCLIV_052390 | 115 |
| NCLIV_067010 | 116 |
| NCLIV_066310 | 117 |
| NCLIV_015210 | 118 |
| NCLIV_022220 | 119 |
| NCLIV_061830 | 120 |
| NCLIV_043330 | 121 |
| NCLIV_024630 | 122 |
| NCLIV_032290 | 123 |
| NCLIV_056430 | 124 |
| NCLIV_018530 | 125 |
| NCLIV_065090 | 126 |
| NCLIV_049050 | 127 |
| NCLIV_047660 | 128 |
| NCLIV_052350 | 129 |
| NCLIV_064950 | 130 |
| NCLIV_029990 | 131 |
| NCLIV_050680 | 132 |
| NCLIV_038400 | 133 |
| NCLIV_020250 | 134 |
| NCLIV_067180 | 135 |
| NCLIV_023090 | 136 |
| NCLIV_045010 | 137 |
| NCLIV_032270 | 138 |
| NCLIV_047810 | 139 |
| NCLIV_024420 | 140 |
| NCLIV_044000 | 141 |
| NCLIV_003310 | 142 |
| NCLIV_062520 | 143 |
| NCLIV_010740 | 144 |
| NCLIV_069590 | 145 |
| NCLIV_044200 | 146 |
| NCLIV_031770 | 147 |
| NCLIV_024870 | 148 |
| NCLIV_028680 | 149 |
| NCLIV_067350 | 150 |
| NCLIV_055720 | 151 |
| NCLIV_032330 | 152 |
| NCLIV_018420 | 153 |
| NCLIV_037520 | 154 |
| NCLIV_055760 | 155 |
| NCLIV_036400 | 156 |
| NCLIV_007770 | 157 |
| NCLIV_057950 | 158 |
| NCLIV_002590 | 159 |
| NCLIV_055850 | 160 |
| NCLIV_046690 | 161 |
| NCLIV_065270 | 162 |
| NCLIV_020720 | 163 |
| NCLIV_064700 | 164 |
| NCLIV_011730 | 165 |
| NCLIV_005620 | 166 |
| NCLIV_056480 | 167 |
| NCLIV_035250 | 168 |
| NCLIV_057820 | 169 |
| NCLIV_001070 | 170 |
| NCLIV_066630 | 171 |
| NCLIV_064360 | 172 |
| NCLIV_009450 | 173 |
| NCLIV_010200 | 174 |
| NCLIV_000510 | 175 |
| NCLIV_030860 | 176 |
| NCLIV_018120 | 177 |
| NCLIV_039030 | 178 |
| NCLIV_029420 | 179 |
| NCLIV_036280 | 180 |
| NCLIV_032780 | 181 |
| NCLIV_065010 | 182 |
| NCLIV_046040 | 183 |
| NCLIV_041930 | 184 |
| NCLIV_027160 | 185 |
| NCLIV_064440 | 186 |
| NCLIV_049600 | 187 |
| NCLIV_046800 | 188 |
| NCLIV_066600 | 189 |
| NCLIV_028170 | 190 |
| NCLIV_055710 | 191 |
| NCLIV_011700 | 192 |
| NCLIV_037500 | 193 |
| NCLIV_036610 | 194 |
| NCLIV_038850 | 195 |
| NCLIV_065590 | 196 |
| NCLIV_056700 | 197 |
| NCLIV_014360 | 198 |
| NCLIV_043930 | 199 |
| NCLIV_013150 | 200 |
| NCLIV_032110 | 201 |
| NCLIV_015160 | 202 |
| NCLIV_024840 | 203 |
| NCLIV_032770 | 204 |
| NCLIV_018400 | 205 |
| NCLIV_033250 | 206 |
| NCLIV_063860 | 207 |
| NCLIV_060660 | 208 |
| NCLIV_041780 | 209 |
| NCLIV_027600 | 210 |
| NCLIV_060220 | 211 |
| NCLIV_004160 | 212 |
| NCLIV_062950 | 213 |
| NCLIV_031510 | 214 |
| NCLIV_056670 | 215 |
| NCLIV_048020 | 216 |
| NCLIV_000740 | 217 |
| NCLIV_051820 | 218 |
| NCLIV_042590 | 219 |
| NCLIV_054800 | 220 |
| NCLIV_000940 | 221 |
| NCLIV_059430 | 222 |
| NCLIV_018800 | 223 |
| NCLIV_062460 | 224 |
| NCLIV_063970 | 225 |
| NCLIV_004860 | 226 |
| NCLIV_043760 | 227 |
| NCLIV_030820 | 228 |
| NCLIV_006720 | 229 |
| NCLIV_016540 | 230 |
| NCLIV_054120 | 231 |
| NCLIV_042450 | 232 |
| NCLIV_031340 | 233 |
| NCLIV_015620 | 234 |
| NCLIV_066250 | 235 |
| NCLIV_042070 | 236 |
| NCLIV_011270 | 237 |
| NCLIV_022970 | 238 |
| NCLIV_005010 | 239 |
| NCLIV_028750 | 240 |
| NCLIV_030660 | 241 |
| NCLIV_034530 | 242 |
| NCLIV_025580 | 243 |
| NCLIV_032050 | 244 |
| NCLIV_055730 | 245 |
| NCLIV_056680 | 246 |
| NCLIV_043110 | 247 |
| NCLIV_053290 | 248 |
| NCLIV_054570 | 249 |
| NCLIV_026150 | 250 |
| NCLIV_028540 | 251 |
| NCLIV_014020 | 252 |
| NCLIV_060140 | 253 |
| NCLIV_038320 | 254 |
| NCLIV_034270 | 255 |

-continued

| Accession number | SEQ ID NO |
|---|---|
| NCLIV_006070 | 256 |
| NCLIV_024250 | 257 |
| NCLIV_047630 | 258 |
| NCLIV_053840 | 259 |
| NCLIV_022950 | 260 |
| NCLIV_027480 | 261 |
| NCLIV_033680 | 262 |
| NCLIV_059450 | 263 |
| NCLIV_061040 | 264 |
| NCLIV_050210 | 265 |
| NCLIV_005900 | 266 |
| NCLIV_065450 | 267 |
| NCLIV_027780 | 268 |
| NCLIV_033270 | 269 |
| NCLIV_030930 | 270 |
| NCLIV_062940 | 271 |
| NCLIV_064420 | 272 |
| NCLIV_020180 | 273 |
| NCLIV_064880 | 274 |
| NCLIV_004790 | 275 |
| NCLIV_030490 | 276 |
| NCLIV_052190 | 277 |
| NCLIV_004730 | 278 |
| NCLIV_042650 | 279 |
| NCLIV_015010 | 280 |
| NCLIV_030890 | 281 |
| NCLIV_034090 | 282 |
| NCLIV_030620 | 283 |
| NCLIV_070060 | 284 |
| NCLIV_012830 | 285 |
| NCLIV_043300 | 286 |
| NCLIV_025450 | 287 |
| NCLIV_060420 | 288 |
| NCLIV_006640 | 289 |
| NCLIV_059340 | 290 |
| NCLIV_009640 | 291 |
| NCLIV_054720 | 292 |
| NCLIV_040970 | 293 |
| NCLIV_045870 | 294 |
| NCLIV_062570 | 295 |
| NCLIV_040440 | 296 |
| NCLIV_040540 | 297 |
| NCLIV_053880 | 298 |
| NCLIV_041790 | 299 |
| NCLIV_057700 | 300 |
| NCLIV_051340 | 301 |
| NCLIV_038780 | 302 |
| NCLIV_028090 | 303 |
| NCLIV_053950 | 304 |
| NCLIV_024030 | 305 |
| NCLIV_026600 | 306 |
| NCLIV_000300 | 307 |
| NCLIV_041940 | 308 |
| NCLIV_026820 | 309 |
| NCLIV_004400 | 310 |
| NCLIV_041120 | 311 |
| NCLIV_016110 | 312 |
| NCLIV_020770 | 313 |
| NCLIV_004710 | 314 |
| NCLIV_004280 | 315 |
| NCLIV_001570 | 316 |
| NCLIV_001450 | 317 |
| NCLIV_008730 | 318 |
| NCLIV_045650 | 319 |
| NCLIV_063980 | 320 |
| NCLIV_033780 | 321 |
| NCLIV_054520 | 322 |
| NCLIV_015180 | 323 |
| NCLIV_060400 | 324 |
| NCLIV_041100 | 325 |
| NCLIV_006490 | 326 |
| NCLIV_023620 | 327 |
| NCLIV_028050 | 328 |
| NCLIV_006180 | 329 |
| NCLIV_070280 | 330 |
| NCLIV_012130 | 331 |
| NCLIV_023790 | 332 |

-continued

| Accession number | SEQ ID NO |
|---|---|
| NCLIV_018550 | 333 |
| NCLIV_008230 | 334 |
| NCLIV_022540 | 335 |
| NCLIV_060380 | 336 |
| NCLIV_027530 | 337 |
| NCLIV_032920 | 338 |
| NCLIV_068890 | 339 |
| NCLIV_062280 | 340 |
| NCLIV_011210 | 341 |
| NCLIV_061990 | 342 |
| NCLIV_001250 | 343 |
| NCLIV_020360 | 344 |
| NCLIV_018890 | 345 |
| NCLIV_036410 | 346 |
| NCLIV_058550 | 347 |
| NCLIV_045220 | 348 |
| NCLIV_000130 | 349 |
| NCLIV_060700 | 350 |
| NCLIV_044410 | 351 |
| NCLIV_038750 | 352 |
| NCLIV_028060 | 353 |
| NCLIV_030900 | 354 |
| NCLIV_041240 | 355 |
| NCLIV_014150 | 356 |
| NCLIV_028240 | 357 |
| NCLIV_046550 | 358 |
| NCLIV_062730 | 359 |
| NCLIV_064310 | 360 |
| NCLIV_043400 | 361 |
| NCLIV_052240 | 362 |
| NCLIV_054200 | 363 |
| NCLIV_021720 | 364 |
| NCLIV_018500 | 365 |
| NCLIV_049030 | 366 |
| NCLIV_029080 | 367 |
| NCLIV_041830 | 368 |
| NCLIV_006510 | 369 |
| NCLIV_051450 | 370 |
| NCLIV_054250 | 371 |
| NCLIV_049100 | 372 |
| NCLIV_057960 | 373 |
| NCLIV_002780 | 374 |
| NCLIV_052230 | 375 |
| NCLIV_056360 | 376 |
| NCLIV_056300 | 377 |
| NCLIV_066870 | 378 |
| NCLIV_048030 | 379 |
| NCLIV_006060 | 380 |
| NCLIV_015480 | 381 |
| NCLIV_032910 | 382 |
| NCLIV_039090 | 383 |
| NCLIV_051560 | 384 |
| NCLIV_007450 | 385 |
| NCLIV_012400 | 386 |
| NCLIV_063340 | 387 |
| NCLIV_020990 | 388 |
| NCLIV_051010 | 389 |
| NCLIV_019000 | 390 |
| NCLIV_060760 | 391 |
| NCLIV_000840 | 392 |
| NCLIV_060860 | 393 |
| NCLIV_064530 | 394 |
| NCLIV_027290 | 395 |
| NCLIV_007110 | 396 |
| NCLIV_006780 | 397 |
| NCLIV_064840 | 398 |
| NCLIV_019970 | 399 |
| NCLIV_011550 | 400 |
| NCLIV_012195 | 401 |
| NCLIV_0260 | 402 |
| NCLIV_051840 | 403 |
| NCLIV_043880 | 404 |
| NCLIV_055690 | 405 |
| NCLIV_054750 | 406 |
| NCLIV_065970 | 407 |
| NCLIV_030170 | 408 |
| NCLIV_004380 | 409 |

| Accession number | SEQ ID NO |
|---|---|
| NCLIV_035910 | 410 |
| NCLIV_039080 | 411 |
| NCLIV_042390 | 412 |
| NCLIV_033850 | 413 |
| NCLIV_064540 | 414 |
| NCLIV_000860 | 415 |
| NCLIV_004750 | 416 |
| NCLIV_047520 | 417 |
| NCLIV_066900 | 418 |
| NCLIV_062630 | 419 |
| NCLIV_051490 | 420 |
| NCLIV_029730 | 421 |
| NCLIV_050300 | 422 |
| NCLIV_038000 | 423 |
| NCLIV_056550 | 424 |
| NCLIV_063370 | 425 |
| NCLIV_045260 | 426 |
| NCLIV_003190 | 427 |
| NCLIV_053330 | 428 |
| NCLIV_004300 | 429 |
| NCLIV_067050 | 430 |
| NCLIV_002390 | 431 |
| NCLIV_020650 | 432 |
| NCLIV_055160 | 433 |
| NCLIV_018290 | 434 |
| NCLIV_016380 | 435 |
| NCLIV_003650 | 436 |
| NCLIV_004920 | 437 |
| NCLIV_058840 | 438 |
| NCLIV_052500 | 439 |
| NCLIV_002770 | 440 |
| NCLIV_069630 | 441 |
| NCLIV_034990 | 442 |
| NCLIV_066100 | 443 |
| NCLIV_018020 | 444 |
| NCLIV_013260 | 445 |
| NCLIV_012510 | 446 |
| NCLIV_013320 | 447 |
| NCLIV_052380 | 448 |
| NCLIV_062890 | 449 |
| NCLIV_031040 | 450 |
| NCLIV_045670 | 451 |
| NCLIV_034470 | 452 |
| NCLIV_066970 | 453 |
| NCLIV_046530 | 454 |
| NCLIV_061940 | 455 |
| NCLIV_069550 | 456 |
| NCLIV_026430 | 457 |
| NCLIV_049570 | 458 |
| NCLIV_019450 | 459 |
| NCLIV_025010 | 460 |
| NCLIV_016970 | 461 |
| NCLIV_031460 | 462 |
| NCLIV_044290 | 463 |
| NCLIV_042660 | 464 |
| NCLIV_064580 | 465 |
| NCLIV_014950 | 466 |
| NCLIV_005420 | 467 |
| NCLIV_006570 | 468 |
| NCLIV_054110 | 469 |
| NCLIV_009390 | 470 |
| NCLIV_051800 | 471 |
| NCLIV_032220 | 472 |
| NCLIV_052510 | 473 |
| NCLIV_016120 | 474 |
| NCLIV_038680 | 475 |
| NCLIV_047080 | 476 |
| NCLIV_032560 | 477 |
| NCLIV_038540 | 478 |
| NCLIV_042050 | 479 |
| NCLIV_063740 | 480 |
| NCLIV_032620 | 481 |
| NCLIV_060500 | 482 |
| NCLIV_029570 | 483 |
| NCLIV_007390 | 484 |
| NCLIV_014430 | 485 |
| NCLIV_000430 | 486 |

| Accession number | SEQ ID NO |
|---|---|
| NCLIV_069130 | 487 |
| NCLIV_015200 | 488 |
| NCLIV_044350 | 489 |
| NCLIV_024860 | 490 |
| NCLIV_001370 | 491 |
| NCLIV_015790 | 492 |
| NCLIV_040610 | 493 |
| NCLIV_000710 | 494 |
| NCLIV_045240 | 495 |
| NCLIV_061210 | 496 |
| NCLIV_069600 | 497 |
| NCLIV_048880 | 498 |
| NCLIV_048040 | 499 |
| NCLIV_029860 | 500 |
| NCLIV_019830 | 501 |
| NCLIV_009780 | 502 |
| NCLIV_022140 | 503 |
| NCLIV_018710 | 504 |
| NCLIV_016370 | 505 |
| NCLIV_041650 | 506 |
| NCLIV_050390 | 507 |
| NCLIV_039000 | 508 |
| NCLIV_068380 | 509 |
| NCLIV_047390 | 510 |
| NCLIV_025000 | 511 |
| NCLIV_037760 | 512 |
| NCLIV_051890 | 513 |
| NCLIV_002380 | 514 |
| NCLIV_020340 | 515 |
| NCLIV_012230 | 516 |
| NCLIV_068970 | 517 |
| NCLIV_012890 | 518 |
| NCLIV_024830 | 519 |
| NCLIV_011320 | 520 |
| NCLIV_062310 | 521 |
| NCLIV_018510 | 522 |
| NCLIV_060800 | 523 |
| NCLIV_044230 | 524 |
| NCLIV_010010 | 525 |
| NCLIV_062770 | 526 |
| NCLIV_039500 | 527 |
| NCLIV_004140 | 528 |
| NCLIV_025910 | 529 |
| NCLIV_021640 | 530 |
| NCLIV_011820 | 531 |
| NCLIV_006030 | 532 |
| NCLIV_061560 | 533 |
| NCLIV_000610 | 534 |
| NCLIV_053870 | 535 |
| NCLIV_041210 | 536 |
| NCLIV_024070 | 537 |
| NCLIV_061440 | 538 |
| NCLIV_003580 | 539 |
| NCLIV_046830 | 540 |
| NCLIV_047040 | 541 |
| NCLIV_063330 | 542 |
| NCLIV_022420 | 543 |
| NCLIV_063150 | 544 |
| NCLIV_010020 | 545 |
| NCLIV_053810 | 546 |
| NCLIV_027850 | 547 |
| NCLIV_042510 | 548 |
| NCLIV_044440 | 549 |
| NCLIV_014040 | 550 |
| NCLIV_004060 | 551 |
| NCLIV_015990 | 552 |
| NCLIV_040600 | 553 |
| NCLIV_018830 | 554 |
| NCLIV_039750 | 555 |
| NCLIV_058180 | 556 |
| NCLIV_049830 | 557 |
| NCLIV_031860 | 558 |
| NCLIV_045440 | 559 |
| NCLIV_025730 | 560 |
| NCLIV_061030 | 561 |
| NCLIV_063190 | 562 |
| NCLIV_017340 | 563 |

| Accession number | SEQ ID NO |
|---|---|
| NCLIV_027930 | 564 |
| NCLIV_026180 | 565 |
| NCLIV_019930 | 566 |
| NCLIV_053940 | 567 |
| NCLIV_029690 | 568 |
| NCLIV_005040 | 569 |
| NCLIV_036130 | 570 |
| NCLIV_026390 | 571 |
| NCLIV_008410 | 572 |
| NCLIV_056910 | 573 |
| NCLIV_068520 | 574 |
| NCLIV_065750 | 575 |
| NCLIV_059980 | 576 |
| NCLIV_066350 | 577 |
| NCLIV_035190 | 578 |
| NCLIV_058260 | 579 |
| NCLIV_001660 | 580 |
| NCLIV_028110 | 581 |
| NCLIV_026540 | 582 |
| NCLIV_025220 | 583 |
| NCLIV_009030 | 584 |
| NCLIV_066080 | 585 |
| NCLIV_020140 | 586 |
| NCLIV_026270 | 587 |
| NCLIV_007900 | 588 |
| NCLIV_011140 | 589 |
| NCLIV_050620 | 590 |
| NCLIV_026210 | 591 |
| NCLIV_042680 | 592 |
| NCLIV_040550 | 593 |
| NCLIV_038410 | 594 |
| NCLIV_050910 | 595 |
| NCLIV_017990 | 596 |
| NCLIV_003160 | 597 |
| NCLIV_031500 | 598 |
| NCLIV_040860 | 599 |
| NCLIV_044840 | 600 |
| NCLIV_036570 | 601 |
| NCLIV_056950 | 602 |
| NCLIV_062880 | 603 |
| NCLIV_011400 | 604 |
| NCLIV_037460 | 605 |
| NCLIV_015260 | 606 |
| NCLIV_013460 | 607 |
| NCLIV_049130 | 608 |
| NCLIV_062350 | 609 |
| NCLIV_028310 | 610 |
| NCLIV_051110 | 611 |
| NCLIV_028230 | 612 |
| NCLIV_039960 | 613 |
| NCLIV_053890 | 614 |
| NCLIV_036250 | 615 |
| NCLIV_010970 | 616 |
| NCLIV_029040 | 617 |
| NCLIV_045600 | 618 |
| NCLIV_024090 | 619 |
| NCLIV_038570 | 620 |
| NCLIV_032940 | 621 |
| NCLIV_003560 | 622 |
| NCLIV_004270 | 623 |
| NCLIV_007330 | 624 |
| NCLIV_047530 | 625 |
| NCLIV_043180 | 626 |
| NCLIV_043670 | 627 |
| NCLIV_024230 | 628 |
| NCLIV_054540 | 629 |
| NCLIV_013360 | 630 |
| NCLIV_022270 | 631 |
| NCLIV_020920 | 632 |
| NCLIV_044600 | 633 |
| NCLIV_024410 | 634 |
| NCLIV_051970 | 635 |
| NCLIV_014760 | 636 |
| NCLIV_029060 | 637 |
| NCLIV_058450 | 638 |
| NCLIV_054190 | 639 |
| NCLIV_017840 | 640 |
| NCLIV_045430 | 641 |
| NCLIV_046030 | 642 |
| NCLIV_056110 | 643 |
| NCLIV_065830 | 644 |
| NCLIV_003220 | 645 |
| NCLIV_044120 | 646 |
| NCLIV_064810 | 647 |
| NCLIV_015530 | 648 |
| NCLIV_048050 | 649 |
| NCLIV_020430 | 650 |
| NCLIV_067220 | 651 |
| NCLIV_030070 | 652 |
| NCLIV_064600 | 653 |
| NCLIV_019750 | 654 |
| NCLIV_050030 | 655 |
| NCLIV_057710 | 656 |
| NCLIV_024320 | 657 |
| NCLIV_062710 | 658 |
| NCLIV_009670 | 659 |
| NCLIV_021100 | 660 |
| NCLIV_052880 | 661 |
| NCLIV_039480 | 662 |
| NCLIV_003680 | 663 |
| NCLIV_051460 | 664 |
| NCLIV_008890 | 665 |
| NCLIV_066190 | 666 |
| NCLIV_011960 | 667 |
| NCLIV_055330 | 668 |
| NCLIV_026340 | 669 |
| NCLIV_044100 | 670 |
| NCLIV_018950 | 671 |
| NCLIV_022560 | 672 |
| NCLIV_044950 | 673 |
| NCLIV_027660 | 674 |
| NCLIV_068630 | 675 |
| NCLIV_055370 | 676 |
| NCLIV_046840 | 677 |
| NCLIV_056250 | 678 |
| NCLIV_048600 | 679 |
| NCLIV_032030 | 680 |
| NCLIV_070190 | 681 |
| NCLIV_017240 | 682 |
| NCLIV_010610 | 683 |
| NCLIV_007000 | 684 |
| NCLIV_050630 | 685 |
| NCLIV_052070 | 686 |
| NCLIV_023540 | 687 |
| NCLIV_066370 | 688 |
| NCLIV_057460 | 689 |
| NCLIV_019780 | 690 |
| NCLIV_026100 | 691 |
| NCLIV_019480 | 692 |
| NCLIV_068640 | 693 |
| NCLIV_065500 | 694 |
| NCLIV_039280 | 695 |
| NCLIV_014330 | 696 |
| NCLIV_010390 | 697 |
| NCLIV_004810 | 698 |
| NCLIV_035590 | 699 |
| NCLIV_021410 | 700 |
| NCLIV_016420 | 701 |
| NCLIV_039820 | 702 |
| NCLIV_003600 | 703 |
| NCLIV_046890 | 704 |
| NCLIV_067160 | 705 |
| NCLIV_055450 | 706 |
| NCLIV_011040 | 707 |
| NCLIV_018560 | 708 |
| NCLIV_027230 | 709 |
| NCLIV_024220 | 710 |
| NCLIV_003890 | 711 |
| NCLIV_065820 | 712 |
| NCLIV_013130 | 713 |
| NCLIV_060920 | 714 |
| NCLIV_046460 | 715 |
| NCLIV_033810 | 716 |
| NCLIV_069460 | 717 |

127
-continued

| Accession number | SEQ ID NO |
|---|---|
| NCLIV_031440 | 718 |
| NCLIV_036510 | 719 |
| NCLIV_025280 | 720 |
| NCLIV_007105 | 721 |
| NCLIV_017460 | 722 |
| NCLIV_063760 | 723 |
| NCLIV_000280 | 724 |
| NCLIV_030650 | 725 |
| NCLIV_024140 | 726 |
| NCLIV_035310 | 727 |
| NCLIV_046540 | 728 |
| NCLIV_066770 | 729 |
| NCLIV_010650 | 730 |
| NCLIV_056830 | 731 |
| NCLIV_053590 | 732 |
| NCLIV_053640 | 733 |
| NCLIV_054910 | 734 |
| NCLIV_058360 | 735 |
| NCLIV_024380 | 736 |
| NCLIV_049400 | 737 |
| NCLIV_067490 | 738 |
| NCLIV_023990 | 739 |
| NCLIV_058420 | 740 |
| NCLIV_001360 | 741 |
| NCLIV_036720 | 742 |
| NCLIV_037060 | 743 |
| NCLIV_008960 | 744 |
| NCLIV_030470 | 745 |
| NCLIV_013910 | 746 |
| NCLIV_012500 | 747 |
| NCLIV_029255 | 748 |
| NCLIV_056440 | 749 |
| NCLIV_054410 | 750 |
| NCLIV_033275 | 751 |
| NCLIV_018460 | 752 |
| NCLIV_046970 | 753 |
| NCLIV_048240 | 754 |
| NCLIV_021570 | 755 |
| NCLIV_027770 | 756 |
| NCLIV_054460 | 757 |
| NCLIV_022690 | 758 |
| NCLIV_046580 | 759 |
| NCLIV_036300 | 760 |
| NCLIV_025600 | 761 |
| NCLIV_008990 | 762 |
| NCLIV_041870 | 763 |
| NCLIV_060890 | 764 |
| NCLIV_027270 | 765 |
| NCLIV_047010 | 766 |
| NCLIV_044340 | 767 |
| NCLIV_008900 | 768 |
| NCLIV_051960 | 769 |
| NCLIV_058810 | 770 |
| NCLIV_006170 | 771 |
| NCLIV_054840 | 772 |
| NCLIV_016430 | 773 |
| NCLIV_045530 | 774 |
| NCLIV_007180 | 775 |
| NCLIV_020880 | 776 |
| NCLIV_023130 | 777 |
| NCLIV_003420 | 778 |
| NCLIV_048580 | 779 |
| NCLIV_065910 | 780 |
| NCLIV_007120 | 781 |
| NCLIV_004340 | 782 |
| NCLIV_044820 | 783 |
| NCLIV_044850 | 784 |
| NCLIV_054510 | 785 |
| NCLIV_026520 | 786 |
| NCLIV_006940 | 787 |
| NCLIV_049920 | 788 |
| NCLIV_052000 | 789 |
| NCLIV_032160 | 790 |
| NCLIV_001930 | 791 |
| NCLIV_032830 | 792 |
| NCLIV_032180 | 793 |
| NCLIV_052270 | 794 |

128
-continued

| Accession number | SEQ ID NO |
|---|---|
| NCLIV_068620 | 795 |
| NCLIV_025130 | 796 |
| NCLIV_049080 | 797 |
| NCLIV_054280 | 798 |
| NCLIV_045490 | 799 |
| NCLIV_038830 | 800 |
| NCLIV_031530 | 801 |
| NCLIV_038390 | 802 |
| NCLIV_013780 | 803 |
| NCLIV_054960 | 804 |
| NCLIV_055190 | 805 |
| NCLIV_030910 | 806 |
| NCLIV_004570 | 807 |
| NCLIV_003110 | 808 |
| NCLIV_024600 | 809 |
| NCLIV_051040 | 810 |
| NCLIV_059830 | 811 |
| NCLIV_046140 | 812 |
| NCLIV_008650 | 813 |
| NCLIV_014050 | 814 |
| NCLIV_068650 | 815 |
| NCLIV_065410 | 816 |
| NCLIV_037400 | 817 |
| NCLIV_030630 | 818 |
| NCLIV_046900 | 819 |
| NCLIV_059790 | 820 |
| NCLIV_010050 | 821 |
| NCLIV_066820 | 822 |
| NCLIV_061340 | 823 |
| NCLIV_063610 | 824 |
| NCLIV_003990 | 825 |
| NCLIV_037540 | 826 |
| NCLIV_028870 | 827 |
| NCLIV_058310 | 828 |
| NCLIV_026040 | 829 |
| NCLIV_024990 | 830 |
| NCLIV_046390 | 831 |
| NCLIV_049110 | 832 |
| NCLIV_031030 | 833 |
| NCLIV_043070 | 834 |
| NCLIV_011840 | 835 |
| NCLIV_060330 | 836 |
| NCLIV_053970 | 837 |
| NCLIV_034650 | 838 |
| NCLIV_045860 | 839 |
| NCLIV_029800 | 840 |
| NCLIV_045190 | 841 |
| NCLIV_005550 | 842 |
| NCLIV_052950 | 843 |
| NCLIV_065640 | 844 |
| NCLIV_033030 | 845 |
| NCLIV_046620 | 846 |
| NCLIV_069400 | 847 |
| NCLIV_009170 | 848 |
| NCLIV_022080 | 849 |
| NCLIV_062220 | 850 |
| NCLIV_049150 | 851 |
| NCLIV_056560 | 852 |
| NCLIV_045350 | 853 |
| NCLIV_024360 | 854 |
| NCLIV_0155 | 855 |
| NCLIV_033090 | 856 |
| NCLIV_002660 | 857 |
| NCLIV_067260 | 858 |
| NCLIV_032250 | 859 |
| NCLIV_016220 | 860 |
| NCLIV_053680 | 861 |
| NCLIV_035750 | 862 |
| NCLIV_040040 | 863 |
| NCLIV_004680 | 864 |
| NCLIV_014450 | 865 |
| NCLIV_016520 | 866 |
| NCLIV_013840 | 867 |
| NCLIV_062610 | 868 |
| NCLIV_008860 | 869 |
| NCLIV_060110 | 870 |
| NCLIV_063620 | 871 |

-continued

| Accession number | SEQ ID NO |
|---|---|
| NCLIV_051920 | 872 |
| NCLIV_060990 | 873 |
| NCLIV_063490 | 874 |
| NCLIV_068580 | 875 |
| NCLIV_065770 | 876 |
| NCLIV_051440 | 877 |
| NCLIV_047350 | 878 |
| NCLIV_060640 | 879 |
| NCLIV_004700 | 880 |
| NCLIV_060900 | 881 |
| NCLIV_061290 | 882 |
| NCLIV_043870 | 883 |
| NCLIV_047370 | 884 |
| NCLIV_055820 | 885 |
| NCLIV_003410 | 886 |
| NCLIV_003470 | 887 |
| NCLIV_006290 | 888 |
| NCLIV_0153 | 889 |
| NCLIV_015950 | 890 |
| NCLIV_019520 | 891 |
| NCLIV_020980 | 892 |
| NCLIV_026590 | 893 |
| NCLIV_032810 | 894 |
| NCLIV_038990 | 895 |
| NCLIV_040650 | 896 |
| NCLIV_042610 | 897 |
| NCLIV_045300 | 898 |
| NCLIV_046940 | 899 |
| NCLIV_048380 | 900 |
| NCLIV_056570 | 901 |
| NCLIV_057020 | 902 |
| NCLIV_058800 | 903 |
| NCLIV_059730 | 904 |
| NCLIV_059960 | 905 |
| NCLIV_064260 | 906 |
| NCLIV_064490 | 907 |
| NCLIV_070170 | 908 |
| NCLIV_001280 | 919 |
| NCLIV_001290 | 910 |
| NCLIV_001550 | 911 |
| NCLIV_001770 | 912 |
| NCLIV_001890 | 913 |
| NCLIV_002680 | 914 |
| NCLIV_004200 | 915 |
| NCLIV_004250 | 916 |
| NCLIV_005500 | 917 |
| NCLIV_005770 | 918 |
| NCLIV_005860 | 919 |
| NCLIV_006150 | 920 |
| NCLIV_006620 | 921 |
| NCLIV_006850 | 922 |
| NCLIV_007580 | 923 |
| NCLIV_007730 | 924 |
| NCLIV_007860 | 925 |
| NCLIV_008100 | 926 |
| NCLIV_009300 | 927 |
| NCLIV_010370 | 928 |
| NCLIV_010960 | 929 |
| NCLIV_011120 | 930 |
| NCLIV_011740 | 931 |
| NCLIV_011830 | 932 |
| NCLIV_012700 | 933 |
| NCLIV_012860 | 934 |
| NCLIV_015460 | 935 |
| NCLIV_016000 | 936 |
| NCLIV_016150 | 937 |
| NCLIV_017040 | 938 |
| NCLIV_017470 | 939 |
| NCLIV_018300 | 940 |
| NCLIV_019960 | 941 |
| NCLIV_020310 | 942 |
| NCLIV_021260 | 943 |
| NCLIV_022000 | 944 |
| NCLIV_022400 | 945 |
| NCLIV_022550 | 946 |
| NCLIV_028820 | 947 |
| NCLIV_028830 | 948 |

-continued

| Accession number | SEQ ID NO |
|---|---|
| NCLIV_029720 | 949 |
| NCLIV_029970 | 950 |
| NCLIV_030120 | 951 |
| NCLIV_030290 | 952 |
| NCLIV_030480 | 953 |
| NCLIV_031320 | 954 |
| NCLIV_031560 | 955 |
| NCLIV_031730 | 956 |
| NCLIV_031750 | 957 |
| NCLIV_032130 | 958 |
| NCLIV_032240 | 959 |
| NCLIV_032320 | 960 |
| NCLIV_032950 | 961 |
| NCLIV_033140 | 962 |
| NCLIV_033830 | 963 |
| NCLIV_034160 | 964 |
| NCLIV_039940 | 965 |
| NCLIV_040730 | 966 |
| NCLIV_041690 | 967 |
| NCLIV_041850 | 968 |
| NCLIV_041900 | 969 |
| NCLIV_042265 | 970 |
| NCLIV_042370 | 971 |
| NCLIV_042400 | 972 |
| NCLIV_042500 | 973 |
| NCLIV_043140 | 974 |
| NCLIV_043320 | 975 |
| NCLIV_044270 | 976 |
| NCLIV_045170 | 977 |
| NCLIV_045980 | 978 |
| NCLIV_048530 | 979 |
| NCLIV_048670 | 980 |
| NCLIV_048930 | 981 |
| NCLIV_050000 | 982 |
| NCLIV_051000 | 983 |
| NCLIV_051530 | 984 |
| NCLIV_051590 | 985 |
| NCLIV_051620 | 986 |
| NCLIV_052340 | 987 |
| NCLIV_052870 | 988 |
| NCLIV_052980 | 989 |
| NCLIV_053190 | 990 |
| NCLIV_053860 | 991 |
| NCLIV_054150 | 992 |
| NCLIV_054700 | 993 |
| NCLIV_055070 | 994 |
| NCLIV_055170 | 995 |
| NCLIV_055230 | 996 |
| NCLIV_055660 | 997 |
| NCLIV_055800 | 998 |
| NCLIV_056020 | 999 |
| NCLIV_056140 | 1000 |
| NCLIV_057250 | 1001 |
| NCLIV_058000 | 1002 |
| NCLIV_058010 | 1003 |
| NCLIV_059620 | 1004 |
| NCLIV_059920 | 1005 |
| NCLIV_060470 | 1006 |
| NCLIV_060600 | 1007 |
| NCLIV_061050 | 1008 |
| NCLIV_061600 | 1009 |
| NCLIV_061720 | 1010 |
| NCLIV_062230 | 1011 |
| NCLIV_063380 | 1012 |
| NCLIV_065240 | 1013 |
| NCLIV_065280 | 1014 |
| NCLIV_065390 | 1015 |
| NCLIV_065690 | 1016 |
| NCLIV_066410 | 1017 |
| NCLIV_066760 | 1018 |
| NCLIV_066920 | 1019 |
| NCLIV_067980 | 1020 |
| NCLIV_069700 | 1021 |
| NCLIV_0376 | 1022 |

Items of the Present Invention

1. A protein composition comprising the following proteins in an amount of at least about 2 times (fold change) higher than the same protein present in the whole tachyzoite, as calculated by quantitative label-free liquid chromatography-tandem mass spectrometry (LC-MS/MS):

| Accession number[1] | Description[2] |
|---|---|
| NCLIV_018120 | conserved hypothetical protein |
| NCLIV_003410 | putative HECT-domain (ubiquitin-transferase) containing protein |
| NCLIV_058550 | conserved hypothetical protein |
| NCLIV_042610 | conserved hypothetical protein |
| NCLIV_032910 | hypothetical protein |
| NCLIV_024830 | conserved hypothetical protein |
| NCLIV_015180 | ATP synthase, related |
| NCLIV_066970 | putative enoyl-acyl carrier reductase |
| NCLIV_025730 | conserved hypothetical protein |
| NCLIV_006640 | hypothetical protein |
| NCLIV_003470 | putative thrombospondin type 1 domain-containing protein |
| NCLIV_019000 | putative adenosine transporter |
| NCLIV_054510 | putative heat shock protein 90 |
| NCLIV_066350 | Os06g0732000 protein, related |
| NCLIV_057020 | conserved hypothetical protein |
| NCLIV_056680 | hypothetical protein |
| NCLIV_044290 | pyruvate dehydrogenase E2 component, related |
| NCLIV_032030 | conserved hypothetical protein |
| NCLIV_052240 | putative saccharopine dehydrogenase |
| NCLIV_008730 | hypothetical protein |
| NCLIV_061830 | 60S acidic ribosomal protein P0 |
| NCLIV_002770 | putative MORN repeat-containing protein |
| NCLIV_014760 | conserved hypothetical protein |
| NCLIV_054520 | hypothetical protein |
| NCLIV_033810 | hypothetical protein |
| NCLIV_043330 | hypothetical protein |
| NCLIV_000430 | conserved hypothetical protein |
| NCLIV_030860 | conserved hypothetical protein |
| NCLIV_048570 | conserved hypothetical protein |
| NCLIV_004190 | putative thioredoxin |
| NCLIV_019450 | hypothetical protein |
| NCLIV_027160 | conserved hypothetical protein |
| NCLIV_044600 | conserved hypothetical protein |
| NCLIV_000300 | conserved hypothetical protein |
| NCLIV_046830 | putative ATP synthase |
| NCLIV_004280 | hypothetical protein |
| NCLIV_006720 | conserved hypothetical protein |
| NCLIV_046800 | putative AGC kinase |
| NCLIV_051960 | conserved hypothetical protein |
| NCLIV_010600 | putative microneme protein MIC3 |
| NCLIV_015920 | Histone H4, related |
| NCLIV_012830 | putative MORN repeat-containing protein |
| NCLIV_0376 | elongation factor Tu GTP-binding domain-containing protein |
| NCLIV_024420 | hypothetical protein |
| NCLIV_036130 | CBR-RSP-4 protein, related |
| NCLIV_036400 | unspecified product |
| NCLIV_006780 | conserved hypothetical protein |
| NCLIV_046940 | putative PWWP domain-containing protein |
| NCLIV_001370 | putative DEAD/DEAH box helicase |
| NCLIV_001300 | putative calmodulin |
| NCLIV_015380 | conserved hypothetical protein |
| NCLIV_038990 | conserved hypothetical protein |
| NCLIV_043110 | putative interferon gamma-inducible protein 30 |

[1]Accession number for the identified protein in ToxoDB database (ToxoDB-13.0_NcaninumLIV_AnnotatedProteins; 7122 sequences; Date 9 Feb. 2015) (Gajria et al., 2008, Nucleic Acids Res. 36; Database issue: D553-556).
[2]Protein description in ToxoDB database (ToxoDB-13.0_NcaninumLIV_AnnotatedProteins; 7122 sequences; Date 9 Feb. 2015) (Gajria et al., 2008, Nucleic Acids Res. 36; Database issue: D553-556).

wherein the whole tachyzoite extract is prepared as described in Example 4 of the present description, and wherein the LC-MS/MS is performed as described in Example 4 of the present description.

2. The protein composition according to item 1, wherein the protein composition comprises the following proteins in an amount defined as indicated in the column "fold change" in the below table higher than the same protein present in the whole tachyzoite, as calculated by quantitative label-free LC-MS/MS analysis:

| Accession number[1] | Fold change | Description[2] |
|---|---|---|
| NCLIV_018120 | 4.15 | conserved hypothetical protein |
| NCLIV_003410 | 3.35 | putative HECT-domain (ubiquitin-transferase) containing protein |
| NCLIV_058550 | 3.33 | conserved hypothetical protein |
| NCLIV_042610 | 3.06 | conserved hypothetical protein |
| NCLIV_032910 | 2.99 | hypothetical protein |
| NCLIV_024830 | 2.7 | conserved hypothetical protein |
| NCLIV_015180 | 2.52 | ATP synthase, related |
| NCLIV_066970 | 2.48 | putative enoyl-acyl carrier reductase |
| NCLIV_025730 | 2.47 | conserved hypothetical protein |
| NCLIV_006640 | 2.42 | hypothetical protein |
| NCLIV_003470 | 2.39 | putative thrombospondin type 1 domain-containing protein |
| NCLIV_019000 | 2.37 | putative adenosine transporter |
| NCLIV_054510 | 2.36 | putative heat shock protein 90 |
| NCLIV_066350 | 2.35 | Os06g0732000 protein, related |
| NCLIV_057020 | 2.32 | conserved hypothetical protein |
| NCLIV_056680 | 2.3 | hypothetical protein |
| NCLIV_044290 | 2.29 | pyruvate dehydrogenase E2 component, related |
| NCLIV_032030 | 2.27 | conserved hypothetical protein |
| NCLIV_052240 | 2.27 | putative saccharopine dehydrogenase |
| NCLIV_008730 | 2.22 | hypothetical protein |
| NCLIV_061830 | 2.22 | 60S acidic ribosomal protein P0 |
| NCLIV_002770 | 2.18 | putative MORN repeat-containing protein |
| NCLIV_014760 | 2.17 | conserved hypothetical protein |
| NCLIV_054520 | 2.17 | hypothetical protein |
| NCLIV_033810 | 2.16 | hypothetical protein |
| NCLIV_043330 | 2.16 | hypothetical protein |
| NCLIV_000430 | 2.15 | conserved hypothetical protein |
| NCLIV_030860 | 2.14 | conserved hypothetical protein |
| NCLIV_048570 | 2.14 | conserved hypothetical protein |
| NCLIV_004190 | 2.13 | putative thioredoxin |
| NCLIV_019450 | 2.13 | hypothetical protein |
| NCLIV_027160 | 2.13 | conserved hypothetical protein |
| NCLIV_044600 | 2.13 | conserved hypothetical protein |
| NCLIV_000300 | 2.12 | conserved hypothetical protein |
| NCLIV_046830 | 2.12 | putative ATP synthase |
| NCLIV_004280 | 2.11 | hypothetical protein |
| NCLIV_006720 | 2.1 | conserved hypothetical protein |
| NCLIV_046800 | 2.1 | putative AGC kinase |
| NCLIV_051960 | 2.1 | conserved hypothetical protein |
| NCLIV_010600 | 2.09 | putative microneme protein MIC3 |
| NCLIV_015920 | 2.09 | Histone H4, related |
| NCLIV_012830 | 2.08 | putative MORN repeat-containing protein |
| NCLIV_0376 | 2.08 | elongation factor Tu GTP-binding domain-containing protein |
| NCLIV_024420 | 2.06 | hypothetical protein |
| NCLIV_036130 | 2.06 | CBR-RSP-4 protein, related |
| NCLIV_036400 | 2.06 | unspecified product |
| NCLIV_006780 | 2.04 | conserved hypothetical protein |
| NCLIV_046940 | 2.04 | putative PWWP domain-containing protein |
| NCLIV_001370 | 2.03 | putative DEAD/DEAH box helicase |
| NCLIV_001300 | 2.02 | putative calmodulin |
| NCLIV_015380 | 2.02 | conserved hypothetical protein |
| NCLIV_038990 | 2 | conserved hypothetical protein |
| NCLIV_043110 | 2 | putative interferon gamma-inducible protein 30 |

[1]Accesion number for the identified proteins in ToxoDB database (ToxoDB-13.0_NcaninumLIV_AnnotatedProteins; 7122 sequences; Date 9 Feb. 2015) (Gajria et al., 2008, Nucleic Acids Res. 36; Database issue: D553-556).
[2]Protein description in ToxoDB database (ToxoDB-13.0_NcaninumLIV_AnnotatedProteins; 7122 sequences; Date 9 Feb.) 2015 (Gajria et al., 2008, Nucleic Acids Res. 36; Database issue: D553-556).

3. The protein composition according to any one of items 1 or 2, wherein the protein composition comprises the proteins listed in Table D of the description.

4. A method for producing a protein composition comprising the following steps:

a. Providing *Neospora* cells in a hypertonic solution;
b. Centrifuging said solution obtained in step (a) under conditions suitable for separating the soluble fraction (supernatant) and insoluble fraction (precipitate);
c. Recovering the precipitate from step (b); and
d. Mixing said precipitate with a non-ionic surfactant.

5. The method according to item 4, wherein the *Neospora* cells belong to the species *Neospora caninum*, preferably the *Neospora* cells are *Neospora caninum* tachyzoites.
6. The method according to any one of items 4 to 5, wherein the hypertonic solution comprises sucrose, and/or sorbitol, and/or mannitol, preferably 10-80% sucrose (w/v in PBS), more preferably 15-40% sucrose (w/v in PBS), even more preferably 20% sucrose (w/v in PBS).
7. The method according to any one of items 4 to 6, wherein the centrifugation takes place at 8.000-15.000×g, during 40-90 min and at a temperature of 1-10° C., preferably at 8.000-15.000×g, during 60 min at about 4° C., more preferably at 10.000×g, during 60 min at about 4° C.
8. The method according to any one of items 4 to 7, wherein the non-ionic surfactant is selected from the group consisting of: Polysorbate 80, Triton X-114, Triton X-100 and Tween 20, preferably the non-ionic surfactant is Triton X-100.
9. The method according to any one of items 4 to 8, wherein the method further comprises the step of homogenising the mixture obtained after step (d).
10. A pharmaceutical composition comprising the protein composition according to any one of items 1 to 3, wherein preferably, the pharmaceutical composition further comprises one or more excipients and/or one or more pharmaceutically acceptable carriers or diluents, preferably selected from the list consisting of: water, culture fluid, a solution of physiological salt concentration and/or stabilisers such as SPGA, carbohydrates (e.g., sorbitol, mannitol, starch, sucrose, glucose, dextran), proteins such as albumin or casein, protein containing agents such as bovine serum or skimmed milk and buffers (e.g., phosphate buffer), and wherein preferably, said pharmaceutical composition further comprises immunomodulant-immunoestimulant substances such as cytokines.
11. The pharmaceutical composition according to item 10, wherein said pharmaceutical composition is a vaccine.
12. The vaccine according to item 11, wherein the vaccine comprises an adjuvant, wherein the adjuvant is preferably a saponin adjuvant, preferably QuilA®.
13. The pharmaceutical composition according to item 10 and/or the vaccine according to any one of items 11 to 12 wherein said pharmaceutical composition comprises an amount of from 0.0001% to 0.5% w/v of the protein composition as defined in any one of items 1 to 3, preferably an amount of from 0.0005% to 0.2% w/v, more preferably an amount of from 0.001% to 0.02% w/v.
14. The protein composition according to any one of items 1 to 3, the pharmaceutical composition according to items 10 and 13 and/or the vaccine according to any one of items 11 to 13 for use as a medicament.
15. The protein composition according to any one of items 1 to 3, the pharmaceutical composition according to items 10 and 13 and/or the vaccine according to any one of items 11 to 13 for use in a method of therapeutic treatment (after infection or after the clinical manifestation of the disease caused by the infection) and/or prophylactic treatment (before infection or before the clinical manifestation of the disease caused by the infection) of infections caused by *Neospora*, preferably neosporosis caused by *Neospora caninum* and/or by *Neospora hughesi*, preferably neosporosis caused by *Neospora caninum*.
16. The protein composition according to any one of items 1 to 3, the pharmaceutical composition according to items 10 and 13 and/or the vaccine according to any one of items 11 to 13, for use according to any one of items 14 to 15, wherein the protein composition and/or the pharmaceutical composition and/or the vaccine is administered to a mammal, preferably to a mammal selected from the group consisting of canines and ungulates.
17. The protein composition according to any one of v 1 to 3, the pharmaceutical composition according to items 10 and 13 and/or the vaccine according to any one of items 11 to 13, for use according to any one of items 14 to 16, wherein the protein composition and/or the pharmaceutical composition and/or the vaccine is administered to a mammal in an amount of 0.001-10 µg of the protein composition as defined in any one of items 1 to 3 per kg of the individual (mammal) to which the pharmaceutical composition and/or the vaccine is administrated, preferably an amount of 0.01-1 µg/kg, preferably at least two times, with at least 14-21 days between each of the administrations, and/or wherein the protein composition and/or the pharmaceutical composition and/or the vaccine is administered intranasally, intradermally, subcutaneously, by aerosol, intramuscularly, wing web and eyedrop administration, preferably subcutaneously.

SEQUENCE LISTING (1022 sequences)

SEQ ID NO: 1 - protein, 2995 aa, Neospora caninum
MVAATLRSSRTRYLYTFLLATLFVCGDLALHKSANASSEAREDSQDAVSDDGFTTLVLTVDPEDSGKSEEFAFTAEYFPPWEASKNDDVKQSFFEAPNRGLPGKFDPMSPSDVRSDVQLRVTTQQTERGLHAEVIVLQEGQMISGFRASLQTKEQAALLQRLADLTSDPNIHFRVEWRGRGDGSGSVIIRTAVHLLATAYKPSVHFNLNLHQIGPGGVRQTIKLVSSVPIDDLNAPGVDIGTFKQLISDHAEPENIITGPGSFSIKRMYNESDPKNVNTQEATLVPWLLRLLDVTLPVTIGGDLTRNREFSTVLPQGPANWNDLLHLYTGMGDAANRGENAPEFAYREPGYRGGSLFLSPEGLRGAARLGDHQPDRLKEYWRQGGETGLNPGDIEHYYGPLFGRTYDTSNNPLLLLDMHGNPLYSPNGVPRFTVGPGQTDLSKLPDHVSGMVLPSVQTRFAFPGNRGFSEYINPARPWSDINNGWKALMAKHKMKFDFREPGLVGVSVNGNWYGLTGDFVENYPTLLHLLGSLAQSTPGFSVEDLTFHFDDKLPAKLPTLFVLDDANDRQVPWCAFEYVVPITARGTVNIKSIMAKGKAAAESPKGCNFRERGFHFTTVHRWGYVESRTPLKIEWHGILDYHGSKEECSLLGKVLKDAHLARRQIAVSFHAEHKATVIPVLETFGPDGQRLTAKPQKPVTATVQFGDDLPGILFDFHKPFQKKKVPTVVYPFLPGRGQGGGPQDALNQGVLGEDYYHRPQKTRIMMRPEIPILNAHDTFVDGSGSHPNVPHFVIPITTGQQQHLAPLKAFRHWLRTAYPGSQLPFNLDRMSDEDLQGVADYLIFRFPNGREASLRAIFGPELFSPNWATVNPEAYRNLMDLIAQPKKVYLAKNFRIVVTDADGRQIPFDIQIEPGDTWAKTLDAFLKAHPTIKPANIKLVLYDDKDSALRQFDINLDMYSSPYTEAVDQQHMKGLQITLETPAPIVSCYQTDPARPGQCLAVDMKRIFCGRVSPAKMLSRAWNDECTAAWIAHADLGEIEDRYLMGQDDVRARSIRDLLTSAKNALKQKHPERVRHLNIPVADVAMSEELNRKMRERAELTVKSGKTLEELDRLRQLKFEIRSLQRQGELQWARLTGATIRTTENGKPVERHIPLNPKKFFVNDKLWKVFKDLAAQVPGLKFENVFNFSFEVMDKDAREQWKKEQTAVAKEAKKQVKAQKTVVDVMFIGPDGSALFQDMGVELRHLSDEALGRLSKGDKRGLITQLAKVYNIPRHFFIRRGGYPSATVSGTKWLITVMLGLVGGPDKKGLSSLFKDPQAFAANLQSAGGFKPTDTVRLVFDNGTAADVPIDSLPQQDLGSLSEIYFPWRKTAGQAQVEKKKAVETKAAEGAGILRKVEVTVMQPSLWPEVFGTWLSDLHEMDLFDDGPITLQIRPEGAKKGQVIRCAVKTLGELYQALNNPEMIRLKCPGMGDLKKPFTFELAVRTPVEQFYKLFNRSRSPEDQRRTAAVLLKLKDHIRSLPEDGQVSFEYRKNKRPLTLQELQQLKSLIEGLQPTESTDSVLTAILRLLGISDQDIAKSGRLRFGIKKAPTSSEQQMLREGSITAVVEDLQGGRRKATVRISVPENEALRLGASAQNYQVHATLFSKNAQQLNTPCGSKSGADVAKATWGQVCQWCNFKLADLPGLGHPTLYIRIVSNEKTQTVRGGQPVTTNIDGHPVVYDIRMPGDPRSSTGMPESIFWNLVERPGSNELGPVWHQSIPKADGGLRQDYSYVDPNPRMWDPKLFGPSSGAFPRNTRAGIDIVTNPEAMESGDAYNPPIRFGFGFRNWNDRDTVKPQFNHMVSGIAPQERNLYQVYIQVPKGDGKYYPCTGIDINQFLQLTREQVARACGLHSSLLDAPFGLYLLKETPTYTRSQPSFPLFYVDTEGREHPSVGQWTDSPAKFFIPHLRGFSPSSLIQLEFAPGVTCHLTQQELMALHTWEAILKRCNMDIGKERPATITARVVVTVKVPNELLQPLLREHGGVSPDQFFRRKSLEEIVALLLSKAHLGLYHVGLQFNDGTEQPYSECPQHLRELPPSQIAGLRHIFIVVFRGGSLNDLLKGMHMSPQTSYGDFVRTVTNKINSPGGLEVPGIPQHIGGTTRPGQSAVIDFDFAAPDSPASGGQPGWSASWRPATVGAFPDNMPIGEIEKDLHHPFLVFLYGIASYGGRPYHEEMKHLDASLRNLVEWMKDSMGIPDPNGILADVVIDTIRCPLPLTAAQLFSLTVGHLLHHCHVTDLETSHSIYVTIVINGHKYGAPGTAPRDFAQLFNLPGTPGTRPLKQDLEISFSPVPGKPPVRGVLPGDVLPLLQSISDKHGQPGVTVVLNFLRQLHALAELPPGADFNIDTKLIPSQSPQQLYLPGEVPQPGPWLTGPVSPGGSAGVPGSGYVAFGPGAGGGYGPGAGGGYGPGAGGGYGPGAGGGYGPGAGGGYGPGAGGGYGPGAGGGYGPGAGGGYGPGAGGGYGPGSRVGVNLLPSGLRLPLLRQPSVQLPRNSMLRGSIGGVGGLPRTEFVVPILPSQKSMPIEQVLKYFGIAPAAVQTLDVQEKPEEGVITVTSGKVTFVPLQGPAFSISMSKINSTDNNSLAALLKAAGRSVADLIGAAASTQPLVLKIIIDHGATSPTKVTTPVGTPSHAKSALEGLTVWKILPPLIKVHSVQTVTIKVQAAAAAEGAEAGAAGESATRPKAAPEASTKFSNKLPNLPAAFVPRQRDASEIEGGPDPNLLIFLEQNGQTTIKFNLRSRINDAVIGQSTVSRMLDVVLPQPNSWHRIFWGLQTDGRACRPTLEFAYQHWLQTQVSALPVPNQSTCLLIREVPLNIKQPPTFFPKPYIFHSPIVILALQGQKQTSIYEEQVDPAVTSQPVTVLLKQLGIPTDQLGTVLQCSSTNIDAPGECPSGSSVTVDPETTVLDTVATKSAFLIVNGKEASGSFLQVLWRRQRGLNAVRKRKASQEYI

SEQ ID NO: 2 - protein, 851 aa, Neospora caninum
MSPLGVRAPKALAVAAFLGVAVACATLFSSSPASLSAPFLLETVATEADASEPLTADEAPRSLPVEESEKAAAPLTAEEQEAVQKSQESHQYQTEVSRLMDIIINSLYTQREVFLRELISNAVDALEKVRFTALSRPEVMEPKKNLDIRIEFDADAKTLSIIDTGIGMTKQDLINNLGTVAKSGTSNFLEAMAQGNDVNLIGQFGVGFYSAFLVADRVTVISKNIEDDQHIWESSADAKFHVAKDPRGNTLGRGTCVTLHLKEDATEFLNEWKLKDLTTRFSQFMSYPIYVRTSRTVTEEVPVEDEETEKTEDAKEKDDVEVTEEDKDEKKDKPKTKKVEKKKEEWEQVNTQKAIWLRPKEEIEDKEYNEFYKSVSKDWSDPLAHIHFTAEGEVEFKALLYIPKRAPSDIYSNYFDKQTSVKVYVRRVLVADQFDDLLPKYLHFIKGVVDSDDLPLNVSREQLQQHKILNVISKKLVRKTLDTMRKLSLDSLKEREEMEKALAAEEDEEKKKELERKLKEKSLYEKFYDEFSRNLKLGCYEDDTNRNKILKLLRFHTSKTGPDATVTLESYVSKLPENQPNIYYAAGESVEQLMKAPEMQIFLKKDIEVLFLLEAMDEPCIQRVMDFEGKKFVSIQKGDVQLDQTEEEKKTEKRLKKAFEPLLSWMKKLLGEKVTKVEVSKRLVDAPCAVVASEWGYSAQMEKIMKTQTFADPRHVRMMAGQKVFEINPHHRMIQYLLTQVTKDGENVSPKVTQMARLLFEVAKLASGFEVEEPKDVAASLYRAVAADLSLPTDESMVSEYELPREEEDVKVGDEEKDETKDEEKDEEKDEEGEADDVKDSEEPVDKHDEL

SEQ ID NO: 3 - protein, 1732 aa, Neospora caninum
MAQQFPIQLHSVVNLADQGVSASSFRFGNVAMHGDKNLVVKDTESNELYIFSLAVREVQEGRVSPSLPAFSFTKKPTQAEAALMHPSEKIVALRAKTEGSAGHMIQVLNLETKARLGTAQMSEPVVYWRWVGPNLLALITDRTVFHWTVGENNTETSAEPVKICSREGRLADAVQIISYAVDKDLKWCILTGISTQDGGKTIDGSMQLYSMELKKQQQLEGHAACFNNIVMDEAVGPQPVICFTEKKRGSPEFKLHIRDIYSSREGGQTPLRLAVDLQMPADAPTDFPLSIHISQKFGVVYIVTKGGYLMLLDALTGTELFRHRILQDAVFLATDSPQTGGILTVNKRGLVCLCNINLQTLIPYITQALVYVPNRQQVATSLAKRYGLPGAEETLMQEFNQHFASGNYKAAARIAATLKSGMLRTAQVIQQFKSVPTQPGQTSAILVYFSTLLDYGTLNAVESLELVRPVAVQGRKDFVEKWLNEGKLECTEELGDVVRTLDVQLAVRVYREAKAGAKVLQALTELGKFDEIIAFAKETKFEADYSVLLRNLVNVHPENAVKFAQQLLSAEPPLADVNQVIDVLLQQRKFQEFTSLLLDYLKSNKPEQGPLQTRLLEVNLLHSPQVAETIFQMDMLTHFDRAKVAALCEKAGLSQRALEFYTDIADIKRVMLQSGGKISQEFTQQFFGNLPPEASLEILTDMLRSSSQNLQAVVAVAIKFHGQIGTTKLVEMFEKFSSFEGIFYFLGSILAFSTDPEVHFKYIEAAAKLNHTQEVERVCRESKCYEPQRVKEFLKQAKLPDPRPLIYVCDLHGYVTELAEYLFKNSLLKYIEVYVSRVNSANAPLVIGTLIDQDAAEDFIKNLLQSVRGGCSAQQLVDEFEKRNRLRLLLQWLEARVAEGNQEPAVHNALAKIYIDTNRDAENFLKTNAYYDSLVVGKYCEERDPHLAFTAYKRAWGACDEQLVDLTNKNGLFRLQARYLVERQAPELWAYVLREENPHRRQAIDQVVSSALPESSSADEVSAAVNAFINAQLPHELIELLEKIVLHNSDFSNNKNLQNLLILTAMKADSSRIIDYVNRLQNYDGAAVAQVAMDYGLREEAFTIYKKFGLFGEAADTLLKSAEEGGEADLERAVEFAQRCNEVEVWNKLGRAQLKNQRVRDAIESFLKAGNGDMYKEVVDAAAAADAYDALVDYLLMARKKITVKDQVIDSELVYAYAKTDRLEEMDTFLSGTNTANVQAIGDRLFEEKHYKAAKLLYASLPNYSKLASCFVCLEDFAASVDAARKAKNPKTWKEVAFAALSKGEIKFAHTAALSLIVHPDHLDSLIERYEQLCLFKELIELLEQGLQGERTHVGLYTELGVLYATYDSSKLMDYIRQHSGRMNIPRLIRACERQNLWKEAVYLHMNYDEYEQAANCLIMHPAAWTHELFVQILQKVSNSDLFYRAISFYLEYHPLQLCLLLKSLEKKLDHSRVVQHVRKAGHLAVVEKYLHDTQHLNITAVNEAVNELLVEGEDVDGLRESILEYDNFDQLALAQTLENHPRVEMRRLSALLFKKNRKFKQAIELSKRDRQYQDAIDAARDSGNSQLVGDLLRFFLSDLEDPAGFAACLYACYPLVKPDVALELAWRHKCMDYCMPFLIQVVREVTTRVDALDKKEETREKEEEKQKSAPNDYVPDYNMPPTGTMLPGMGGLALMPPSYTPQANAFPPMGASAGMMGSAPPANLGQPFAPF

SEQ ID NO: 4 - protein, 1937 aa, Neospora caninum
MGTMMSPRLADCVLFLFALIFLHHVTVYKVCEAKSLQIIRPHHNLTGLEVQNSAADWGNEGKEISFAQTYREKDIWFGLLYYEYVINASTTMTLAFKSMAKYVYTAPFLTRLFASNRWLKYATLDFPQKQQLVRKIARRATSKSLFSKTPPTDKVAELFADMYLRRVTSRLSRTRGFRSPQYLNMKANLTKLIKDSNASTDAMDVVLGNNTENMFTWIDSVRQNPFTTVKNVVVHAFDNGLRGFSGMAEWEVNQGCFALSQQTRHILPFSSLFPGGILGKIGQKLMRSYIMFFHPVLANFKGLLALFLGVLCKVRLPTLINAIFGAIFRAKRRVGRYVHKYFFKTIGLRKDITGKMLVDDLVRGSGAVMVTLLFQLHGVDIDAISRRGEKVESGVLAGQGVWAMSDGLFVGLKDFAHLFRAYFDRYVNLTSGIYTYCSKQTTTFFSESELDEFYCDRNKSYLTVIEQDFFGLASNFLNHMVKCLKMDLKYFEGYLANIMSIFYEMTFATLESDIVSAINATHGRAPHQLELEAILRRRHQASNPPREAEMPRTMFRKPWMRLAIRKLAHGYFSSAAGLAMRSLLNQAGRERTPKFQKLLDKAFQRVEEGSKLIRSSMAVILGRFFNSQALIARAQEQTVRMKMFEFINKCQNPEDPNHRDVCGNNVTTNIDEVKFISKSLLSLNIGIMASPRDLILTQIMETDPTKGAVDPTQFFAEWEAWLQGKGYTPANKGKEFLLYAQEINQKEKILPFVEAVSQTLRDRLRFGRFDQEGMDALRLSDVNGRSAIFRHRLKEIRPDPLDAPATFEVINVNEGVLRFTSKPGIPFEGSLEYADDRKELRNIQRDPLAIKELMVSQLMQIKPRLSAEMTATLMMVLHRYSPSFHKHSFATFLQNLSPKMFFDGLLAFADQHQQQGEATVQLDRRLYSFSMSFQTFKDIIFNSLNTMVLRMHSLDTADSLSVFLVGLVHYAFQKIQKNRTGRTLVMQHFQRSLVHVMQSVDADRFLTDFPECRFLVESNAAVDEIVAIKCTVYRFVKLRSLELPRAMQPDVEESKMTETRARAYVSGFLEYLDALRSERTSWSSFLNYKGFVETAELYKETVGSYSFEELERQIKAEPITDLSALEQMRAMMDPSLGHIIPPKKDEGTTQVFRRIWDNMGELSSGVRHKVRKALKQLKSRMISIFGSTSIPKAIRPFNVMNSSQFFGALEHAEFRAFPDTKAPPEDILRASDLTIFGRVLLTLEATPLYLDNPKQMADVVMQMRAIPFYSLECQELFREIKETVGQMSHEDLKVAVGWMLTFNIGKGLTGSTVALGLLALAGVRFTNSQITHQDKIGILTALDADTLRFIKKILLMPMVFRHMASLTDGEAMSLLRFVPKATLLVAYPAATRYLPLSEPVIVVDAIDKLVDSKAIDVVQAQLGQVALLPGESNHEAVCRVMITRIGQELEVSAEDAMKFWTRSQMFFDKRLPAACILLIHLRAMREQNIQQTTVTALIDTLYYNGTPVNDYLAFISKKGANELERHRQIDRIGSLLTIVYVAVVSGSLQVDASFVGYSDETKILTFHSRRSFRGAEVSLLNACVQATAHIMGSPKEKPEIFQVSLSSYLVGEWFRFVEPKRLEAYAEAYRAAGGFQNISRETLKNISTVYVYYDIGDYFFSMRQRSPYPVKEIVKQASLNMITDDATLDDFGAAMVAVDMSERIKQAKIKCYEDALKDYAEYVGKSRIAQEMMKLDCVHNYLIDLGSLGYSASSITSQQKDQIIAVLDKAFAAKCEEMYTALIGSNPDIQKLKQQAWAFATLPHISLNNASRLATVGNMLHTLITEITAGTPWADVADGIAKERTNVLWERVGDVSQRTQIYTAVDRPYLFNPFAVTLDFLIYVKTNRAQSFRLPKILLMKRAAVLKELPFRKKTTPPGMADYKHRAAAFKDAFFAP

SEQ ID NO: 5 - protein, 831 aa, Neospora caninum
MASKGPSEEVKTAAALKKKASDVHAVDQSGNVYKGFQIWTDLAPSVKEHPDLMFAKCVVQAGSGKGSLTCVQIDPPGFDEPFEVPQANAWNVNSQIDPMTYGDIGMLPHTNIPCVLDFLKVRFMKNQIYTTADPLVVAINPFRDLGNTTLDWIVKYRDTFDLTKLAPHVFYTARRALDNLHAVNKSQTIIVSGESGAGKTEATKQIMRYFAAAKSGTMDLRIQNAIMAANPVLEAFGNAKTIRNNNSSRFGRFMQLDVGREGGIKYGSVVAFLLEKSRVLTQDEQERSYHIFYQMCKGSDAAMKQRFHILPLTEYKYINPLCLDAPGIDDVAEFQEVCESFRSMNLTEDEVASVWSIVSGVLLLGNVEVTATKDGGIDDAAAIEGASLEVFNKACQLLFLDAQRVREELTIKISYAGGQQIKGRWKQEDGDMLKSSLAKAMYDKLFMWIIAGLNRNIKPPGDFKVFMGMLDIFGFEVFKNNSLEQFFINITNEMLQKNFVDIVFDRESKLYRDEGISSKELVFTSNAEVIKILTAKNGSVLSALEDQCLAPGGSDEKFLSNCKNTLKGTNKFKPAKVCPNINFLIAHTVGDIQYNAEGFLFKNKDVLRAEIMEIVQQSSNPVVAQLFAGIVMEKGKMAKGQLIGSQFLTQLQSLMELINSTEPHFIRCIKPNDTKKPLDWVPSKMLIQLHALSVLEALQLRQLGYSYRRPFKEFLYQFKFIDLAASENPNLDPKEAAQRLITSSKLPREEYEIGKTMVFLKQTGAKELTQIQRDCLSAWEPVVSVLEAFYVRQRNKKQLMKRAPFIIRAQAHIRRHLVDNNVSPATVQAAF

SEQ ID NO: 6 - protein, 1640 aa, Neospora caninum
MIASVQILLFSGVLASVAASPTADRIALAPTVINERGQGLLVSDALPTTKTGIDITPAISLSQQAAQKTRVFGGPARAAPGGSAAADDLFGGEDFSPPPMNVAAAPARHNGVHFLECHAVDGKIECAGQGAGARQPFFRGGIDPMEVHEILQSRTVGPADYDEERPDLVTLQRFISSANGSNSPLLEDPVQVCLARRKPTYTCQLLHEFAATSVIVEESSNLVCEERAPLTIAEKNKINEAVKGKTSQIGVGQSPRPPARTNASPSGSGAPAQGSSPSQGIFAELEGTQEAPTENEEDGRGAQDRTPDEEYQRPPPYNPDATDSGVPQAVQDAYEEARPLQEATIDKFRRDASAAAAAADQFAQVSAYNAMQSALTKISAGYHLRAGCHVILSACKRLVEAVAANPPGPGTVLPLDELRTQLLATLTQDFALAQAFLDYAMNIVHSAVETLTPQMVANALLELSGVEELINHTARVKSRLASRGQDSDANVRKEIVRESFRQLKMELFQEIVAKVCQVMDNPNAYIQTVPVIVGQSPMAPLRTGGHLGADYILHLRNDLCDVTASDAQIFPSAPADEGLKDFPRHNLGERLLGWMDIMARTKTARKEVFKIIDFSDSREVLLFASEAWKAQYASLQAPAAPAPSFYGITSSGCRNVNEIMKSRYFDMYIHHSAFMKLQRHGNDNSRQRFLHKVALLQNDGIVPQLPLEYDYELMELTAAMQQSFVAAPKGILTRRKARHSPYGYLDLCNVACYQKVDRLHNDVMTNVFFSLDTTLMKLVGKIHRAYGIGKAFFQLGARDQQIADPNLGMWARRLYEHWQSHNEVKAMKGEKPVKVDYKNLRRGEFTFDTIRMRDALLRYGNMLKADPITRDVMNLVVHTWIHIRGIRNAAKGFKNSNKLKESIGESAIGAIFSKLWYENDSVVAKHQELKPFGAPLASMALQIGFFLHTIVEEYKMSILEKAGAQIKSWFLGIFQKNKRRTVPRTWKAIVAATTRKPIVNLKAYQGALMVIKSLAKMFRERFLHRFYMQGQGTKVDFNTPTLLIHALVALWMDPTLDRLDVSSPSIPNAKKLFWYYLWVNENGPSNAAARIVLVGCKKYTHLFPGVVRSVTTATGEVVEAGSDILKIPAIPLKRSAVEAYMNHLQATYKDPLTVVQVALDLAERCEGYSPANEQATRNSARAQPREQRISGHATFTLGREGTAAGSFVEGAVEDETEEESEIDADDSDALQDQEGSFVQLRKLFRRKKKAAAGDKPAQTDAQPQPKVRRGRPDVDASAVILGSRFALDLWCSKYRQMVVEKLSGIKTKDTTVMQQEISKVFTAVTSIKIALPDYKEFWDFSLRCDWMDGYPDQDRMRAARADMVSYAMAKAGRGKRLKRMLQKATSWIRKKAFSVAKRFKSLKRRISNAIGKGKPPKAKVPDWAVINVGLGSWTGKVFSTQLTFNEEEMSCNGPHEPIRVMTWRQNRFTTFSSSSTNAERSYVLVDKSEESHCWATRDALLHKGWTGLPVYQYEEPSGFWLEDIVRGNAPGNGFVVNWDNYLTTNGNLTLQDIDPSASSQRLSSFATMRITDSNGKVIYQGPPTGVVQTQGGRVTLGSIRNLVSGVQTRGDNVEVRVNAAGPQLTSVSDLDARFKDIPDL

SEQ ID NO: 7 - protein, 666 aa, Neospora caninum
MAVAHKLLSLLALFCLVGVPTLRPVAADEAEEGQVKDVVIGIDLGTTYSCVGVYRHGRVDIIPNDQGNRITPSYVAFTDDDRKIGEAAKNEATINPTNTLFDVKRLIGRRFNEKEVQKDKGLLPYEIINKDGKPYIRVMVKGQPKVLAPEEVSAMVLTKMKETAEQFLGKEVKNAVVTVPAYFNDAQRQATKDAGAIAGLNVIRIINEPTAAAIAYGLDKKNEKTILVYDLGGGTFDVSVLVIDNGVFEVLATAGDTHLGGEDFDQRVMDHFIKVVKKKYDKDLRTDKRALQKLRREVERAKRALSSQHQAKVEIENLMDGVDFSETLTRAKFEELNADLFQNTLKPVKQVLEEADVQKSQVDEIVLVGGSTRIPKIQQLIKDFFNGKEPNRGINPDEAVAYGAAVQAGILSGEGAQDMVLLDVTPLTLGIETAGGVMAKIINKNTVIPTKKTQTFSTYSDNQSAVLIQVYEGERPMTKNNHLLGKFELTGIPPAPRGVPQIEVTFDVDRNGILSVSAVDKGTGKSEKITITNDKGRLTPEEIERMISEAEKFAEEDKKVKERVDARNALEGYLHSMKTTVEDKDKLADKIEEDDKKTILDKVTEAQEWLNTNPDADAEETRDKLKDVEAVCNPIISKVYGQTGGPGAGGAAGGADDDDYGGHDEL

SEQ ID NO: 8 - protein, 1479 aa, Neospora caninum
MTRECANLPLGRTFLLLVLLSAATDSPVASRSRVLQFFPSFSVIPSEAAQPDASGNWQPGQGGGFRPTGYQHIVTKTVNEELPEDLKVYTSGSPGSSVGATVDFGSGGYFFANTGGRPDESTLTVFTAGGPLPHASWSWAGSPPEIQTTGASQISFGWVPETETPSLSERNSLELKKMLRDEGLVEALQLRAAEKGCPVTVLHNLRQIQVSFREILHEEIESRSNPAKLYQVANSYVRHGVGSGATSWGTAQSVEFSLLDMQASSTANRNPSSASSFFETRAGAAPESEGIRVSRTPPPPRAVPLQRDQSEGDRNPTAKRLVGTQLGLYLECKLAALLGHPTLFLNPYYTEQQLLEAVAEALGLAPPNRRETEAGASSEAEQHNGSVDQLLGAIEIFRLGPNPYTLGHVLSLMIGYLDYNAFFGNSPSKPFYSWVTLAASAGNDTGFAMLDEMCDNHRGPKRRGSKHWYQRGGSRKHKSETMSPLQRHLCDALEIVLNGVQQIQIELMDELGKYQTGVEPLVDPSTNSARIHTRVCRGLSPVCDYEATILSPVRPLESHEQQDSLKTKKAFNLITGYGSGHVGQISGSIAEPFSHTWRTRWGKVVADPTAYPEILERALWFDDRELMAKQHGALFKQYDKITKDAMSFGSFAAVENGLAKRDIRSKLEGYTSQRKEFVVKRQQSRLSRFRKKHSEQDPLAFRTAILLSLNSRTYCTQTKSFISSFRAFLSRQFQKLSQGRNLPKTQRSLMAFLRTGQVKFYHEWCSFDPLATNALFMLRFALSGNDPAALNDRQHTRVGRSKKTLRILQSKWTPAMLKKLMRGINQKKMAQEAKALLYRSLDSSVLSSILTSFDFITHTQANLEVNQNAFMYHEVQASAVSRKSSADKAKHQLHAEGLVRHTDDVIKKWANYGIPGDIKRRLARGEKLPEGTSFGGIPIPDLTNWDAQLNQKWLDAYNAYLKHPYGRAALSAKDPVAMLVRDSRDRLQAEGEGTIFLGRIAKRVHRSRNLFRRAGRALKTFFLSLLRENEQSEYAVWFGVKVDMRQVIQTCRAVNAVAEVVKNDRLYGYVTDGWLELVKDVVAGYTRAPLRVPGYDAISAASEQMRKKGEAAATARNQGFLSLHYDYAHLSEADRRKEFQQSMCMEHCEAIWKLIMAFVMPNLQNPKKLKGYEKDFSDAKEIERLNSPHHVNAFRFGLSVQIDFFDNMLDKTSKKNLKAMKYGASTWFSYAMKFAGQVNSEMGNPNLGTALYMQAPYYGDYIRKWMEERRAARKQAIIGVLTLGMMGLYSLLSVTDIVQHMEDIGGAPPASCVTNEILGVTCAPQAIAKATTSAAQVATQDFLKVGLFAGLAPYLMLPMAIVSVWNILKSEIKILLQFEMAVKHMFSRLKRWLAAPFKNWWAKRGRLKDALFRRASQTYKKTEAETKKEPRPRNLHNPSSWGGSELDSLGVPPESFVQEFEIRYTTPVFPMSAPLIKTS

SEQ ID NO: 9 - protein, 671 aa, Neospora caninum
MADSPAVGIDLGTTYSCVGVWKNDAVEIIANDQGNRTTPSYVAFTDTERLVGDAAKNQVARNPENTIFDAKRLIGRKFDDPSVQSDMKHWPFKVIAGPGDKPLIEVTYQGEKKTFHPEEVSAMVLGKMKEIAEAYLGKDVKEAVITVPAYFNDSQRQATKDAGTIAGLSVLRIINEPTAAAIAYGLDKKGCGEMNVLIFDMGGGTFDVSLLTIEDGIFEVKATAGDTHLGGEDFDNRLVDFCVQDFKRKNRGKDISTNSRALRRLRTQCERTKRTLSSSTQATIEIDSLFEGIDYSVSISRARFEELCMDYFRNSLLPVEKVLKDSGIDKRSVSEVVLVGGSTRIPKIQQLITDFFNGKEPCRSINPDEAVAYGAAVQAAILKGVTSSQVQDLLLLDVAPLSLGLETAGGVMTKLIERNTTIPTKKSQTFTTYADNQPGVLIQVYEGERAMTKDNNLLGKFHLDGIPPAPRGVPQIEVTFDIDANGIMNVTAQDKSTGKSNQITITNDKGRLSASEIDRMVQEAEKYKAEDEQNRHRVEAKNGLENYCYHMRQTLDDEKLKDKISAEDRETANKAIQDALDWLDKNQLAEKEEFEAKQKEVESVCTPIITKLYQAGAAAGGMPGGMPGGMGGMPGGMGGMPGGMGGMPGGMPGGMPGGMGGSGGPTVEEVD

SEQ ID NO: 10 - protein, 471 aa, Neospora caninum
MRAGFSFVLLAVGLLATASVYCAAEEEAVTVLTASNFDDTLKNTEIVLVKFYAPWCGHCKRMAPEYEKAAKILKEKGSKIMLAKVDATSETDIADKQGVREYPTLTLFRNQKPEKFTGGRTAEAIVEWIEKMTGPAVTEVEGKPEEQVTKESPIAFVAELSSKDSDMAKLFEDVANESRQLGKFLAKYGVSDEKIYSLRYEEGTEPFTGKTKDELKKFVDTESFPLLGPINAENFRKYIDRDLDLVWLCGTEKDFDEAKAAVREAAKKLRDTRSFVWLDTDQFKGHAENALGITEFPGLVFQSKKGRFVLPEATSSLKDAAKISKFFEDVDAGKIERSLKSEPVPEKQDEAVKVVVGKNFEEMVIQKDKDVMLEIYAPWCGYCKSFEPIYKEFAEKYKDVDHLVVAKMDGTANEAPLEEFSWSSFPSIFFVKAGEKTPMKFEGSRTVEGLTEFINKHGSKPLKKDDKGEEL

SEQ ID NO: 11 - protein, 951 aa, Neospora caninum
MASFVEGVGPRLRRAPGARASRSSFPSPSGLVRRGFLFLSLCLVSLLSLRPPALFAEAQVVGLDLGSEFVKVALVAAGRPIEILLNTASKRKTSNAVSFADDEKREMGDDGAAQAAKKPDRVFLHPNLLLGVNATDFGLVDVTADSPDAAFLPVELKEKLLPSGYPHDYYPYRLFMDKRRHSLAVLARDGLYLPAELVTASMLAFVKKLASQAAGIDSEATIGCVISIPCRYTQRQRQALRDAVEIAGMHAIAFNHHSVTAAVQHALDLPTNTTATKLFYDVGSSTVDVGVVRFSPVQLPSKKEVLQVQLLACETTAGAGGHHVDLAIAEKMREVFEKRHPGKALLQVPRALKKLVKQAVMSKHVLSANKQTHFRVEGLHNDVDFHEPIERADLEGLLQEKGMLAKLKASLDATLNHAGMDIANIDQVELLGGGWRVPRVQQELNAMMGGKEVGTHLNGDEAMATGAAFIAANSTATFRVKQMLLHDISPFEYVLKIASIAEEDDADAGVKHGDRVEKTKVLLGRNGRLAQGSRTVALRTTHDFELELLEDDVPLMKLAVTGVSEVAKKLEEEAQKKAEAEKKAEVGEVEAEEKRLPKANLVFKIDGSGVIGFDRAYLTQEYPIYVPVPATTTKATTTKSASDASEQTSTTTPTPQPKFKKIMKQVSEPLAVEETLTLPLPLTAAERKALRKQLQELEASDLRVHRLAEAMNRLESSIYAARGLLDEEMIARVSVPETREELRKQLEADEEWIYDSAKAEGIEAVKKKLSALENVVEPMKKRAEELEARPKVIDKMEKALVDVVSRLEQIATKRPWVPEEKLKGVRAFGEDVGAWWREKLASQQSKKDTEEPVFTKAEVLAKVKELGAAVKALENIPRPTTTTTPPPKENGDQKDADTEKREKETEKTETEKTEKESEKAETEKAEPEEKREEGQTSGKDTAAEQKTREEL

SEQ ID NO: 12 - protein, 706 aa, Neospora caninum
MADTETFAFNADIQQLMSLIINTFYSNKEIFLRELISNASDALDKIRYEAITDPEKLKGAERLFIRIVPNKQNNTLTIEDDGIGMTKAELVNNLGTIARSGTKAFMEALQAGGDISMIGQFGVGFYSAYLVADKVTVVTRHNDDEMYVWESSAGGSFTVSKAEGQYENIVRGTRIILHMKEDQTEYLEDRRLKDLVKKHSEFISFPIELAVEKSVDKEITDSEEEKEGEEKKEEGEEEKKEGEDKDEKKEKKTKKVKEVVVEYEQLNKQKPLWMRKPEDVTWEEYCAFYKSLTNDWEDPLAVKHFSVEGQLEFKALLFLPKRAPFDLFETRKKRNNVRLYVRRVFIMDDCEDLIPEWLNFVRGVVDSEDLPLNISRESLQQNKILKVIKKNLVKKCLEMFQELEEKKEDYNKFYEQFSKNLKLGIHEDTSNRNKIAELLRFHTSKSGDDVVSLKEYVDRMKENQKDIYYITGESRQSVASSPFLEALRKKGYEVIYMTDPIDEYAVQQLKEFDGKKLRCCTKKGLELDDDEDEKKKFEELKAEFEPLCKLMKEVLHDKVEQVVVSNRITDSPCVLVTSEYGWSANMERIMKAQALRDNSMTTYMVSKKTMEINPTNPIMVELKKKSSADKSDKTVKDLIWLLFDTALLTSGFSLDEPTQFAARIHRMIKLGLSIDEDDELKAEEDLPPLEEIEGAVEETSKMEEVD

SEQ ID NO: 13 - protein, 950 aa, Neospora caninum
MARKKRTGAAATSEESAVANPTPVPQKAEKAAPKHEANAPPSDQAHARDSTQELLAATAVVARQQVDTSNMSASQKKNLKKKIRKQEQRQQEAAVLAAVRPETAKAATGMAGHYAEQETTIRRRLEGLKRAVSQFQSGGRGAAGPNAKKLGQDFDSLLREIDATLERETAALQKPLSKRSTVQQLQQQIRDVEAQVQKQQRELQRQANQGQPGDGPSAGELRGCLEESLRYVVHLREQLILTQQQNELRVFRDRLTALKTEGESLLKALHAGGNSPGERGRGAGSPSNGTSGASGAKEAQWRRRLGDLARGPSADRQKREQKPEENATLPPLVVQHVNLGPDAMGLLFPGGQNPVLVRKLERSCGLIVDRHSGGAGRAGVVSVVGLQAPAVERCVAMLASLDEGMQPEKREKHRVVVEGRTIGSVIGAGGANLRRVEEENDVVVWAEGNEMIVMGATPAKIADGVRQLKEVVASPAASASGAGSPGGATSLTFPAPIARALAGPSFRAVLREVESELHCAIRAPKGGAEGVILVQNASPENAAAVAKRLKDEASKLVVKTISADGEKVLKLLKGNAPGFIASSREKDHVTYLRGENELTVVGPSAVIDEAVTAAEEGLLLLDRVTGQVTIPRNLSRVVTRAKRGHIEKATGVLFRPPRNPATGDLVLSFMGTKEQVEAAREMLNTVLKEEGFSEAMPVGKEMTAALLADRGQGVRDLEEQFGVTVSIERREHRLVVRGNEAAVQACLAALRERQDREFADEKDDSVVERVAVPKEQVAAIIGRHGARVRKIQTQSGVESIRMDGSEGVAVIRGSAEAVAKAVKLIEEALKEGTGAAQSGSDNEDQRTEDVEGGARGNRRGQRGGPVKRAPQKPLNVDASDETAFPSLDAAALNEGRSRPGAGRWKRGGRSAKPGTEEEAVNGVATQNGTHKREEEVPTGDAPNAGEVCCN

SEQ ID NO: 14 - protein, 949 aa, Neospora caninum
MAPPSGVTSASPQSPAETDVAVCPSVICTSETKLEEWPHPRLPPFSIDYVELRYPQVAIFHNVKDKPVVRYTWPTTTGAARGAVVLLHDQGTHTMFEWLKHLPPLSKEEREQMEEDPDATETEKKEFMRMRKASHYEGSWVQKFNDAGLDVHAIDLQGHGLSKVVEGKNYELPCSFDEFAEDTCWLLEEVCRHSTLPIFIVGQGLGATIAARAVEMLARQGKLGKPHVPPQKSADAGVSDQFSTTGTSQNSQAGNEARGLQYATETQYCLHTGKGKKEVPVEHITVQARPIPIAGLVLLSPLLTLKEITPEEMHKGKKHANEGIMTRLARCFGSSSDSPHPLAGLLGFRMHQENPLMPDYNVWYKNDTMTIKGLTPQALYNQIRQGIDSAVDDARWLLTPVERDSAHTFSLKDWQEKHRRWMEMMRTKPPSVLASLIVDKNKDIPEVPDLAPWLKDEFEDQELSSRPWRLQERAAAQEAERNASRGPLASRLSERAKLAYYVNVLLVQSLADTTANPRGTAYFFKRIGGRIQASREILVQLGELPEEEYIGSCSSCRHPDVRQDDDSAKLTAVEFSTESDDSGWVEVVTNRPVTAGSPGQSQVSPPKGSSPAGSPSGQVQGSRGQEFVDDICRESVTSQNEESANQTDGYEAASNTEAQSEETETGDNEAVQERVKKLMEVNMRLDKDLQLKTTEEATEGMSRQGTFVRPSYLQRFDTEDLQRAKREAEAGFVGVEEVKWVKEVPARGVGPLACCGGSTGRVRRVDLVEAKVRLVDRIVMMEATDSVKALIDEIGERERLQKEAAKQKKEQSSWFFNCIAGGEPVEKPVPQPVFWEQKRLWRNVQGVVVDESGRRVPVEEVERLRTQKPEDYMRLFFRYGAATGNGNHARTAMWLVPDMYHSLCQEDKDGQLAAKLLDQWILPVLGDLEERELVWQKVNRSANGAKAAN

SEQ ID NO: 15 - protein, 448 aa, Neospora caninum
MGKEKTHINLVVIGHVDSGKSTTTGHLIYKLGGIDKRTIEKFEKESSEMGKGSFKYAWVLDKLKAERERGITIDIALWQFETPKYHYTVIDAPGHRDFIKNMITGTSQADVALLVVPAEAGGFEGAFSKEGQTREHALLAFTLGVKQMIVGINKMDSCNYSEDRFNEIQKEVAMYLKKVGYNPEKVPFVAISGFVGDNMVEKSTNMSWYKGKTLVEALDMMEAPKRPSDKPLRLPLQDVYKIGGIGTVPVGRVETGILKAGMVLTFAPVGLTTECKSVEMHHEVLEQAVPGDNVGFNVKNVSVKELKRGYVASDSKNDPAKGCATFLAQVIVLNHPGEIKNGYSPVIDCHTAHIACKFAEIKTKMDKRSGKTLEESPKCIKSGDAAMVNMEPSKPMVVEAFTDYPPLGRFAVRDMKQTVAVGVIKSVEKKEPGAGSKVTKSAVKASKK

SEQ ID NO: 16 - protein, 736 aa, Neospora caninum
MASLASGASLAYRASYCSGAKTRSISNSLLGRATFANKQMTSVAAPTASLRPSGFFSDLLTQGGKAVSSSPFRNLNGGLYRNACSALNSERAGVLSSFSRYLSTSAPRMNKARGDVVGIDLGTTNSCVAVMEGSQPKVIENSEGMRTTPSIVAFTSDGQRLVGIVAKRQAVTNPENTVFATKRLIGRRYDEEAIKKEKQILPYKIVRASNGDAWVEAQGKSYSPSQISAFILTKMKETAEAYIGRPVKQAVITVPAYFNDSQRQATKDAGKIAGLEVLRIINEPTAAALAFGMDKDDGKTIAVYDLGGGTFDISILEILGGVFEVKATNGNTSLGGEDFDQKILQHLIDEFKKAQGIDLTKDKLALQRLREAAETAKIELSSKVQTEVNLPFITADQSGPKHLQVKLTRAKLEELVGGLLQQSVEPCEKCIKDAGVSKSDLSDVILVGGMTRMPKVTELVKQIFGKEPSKGVNPDEAVAMGAAIQAGVLKGEIKDLLLLDVCPLSLGIETLGGVFTRLINRNTTIPTKKSQVFSTAADNQTQVGIKVYQGEREMAAANKMLGQFDLVGIPPAPRGVPQIEVTFDVDANGIMNISAVDKSTGKRQEITIQSSGGLSDAQIEQMVKDAEMYKEQDEKKKDAVQAKNEAETLIYSVEKQMTDLKDKMTDADRTDLQEKITHLRSTLGQEDPDPIREALKTLQEASWKISQQAYNQAGSTDSSSTSGSESGSESGDKKSS

SEQ ID NO: 17 - protein, 316 aa, Neospora caninum
MAAATPAPGGKKGNADSQLMNTAKDFLAGGISAGVSKTIVAPIERVKMLIQTQDSIPEIKEGKMPRYTGIVDCFRRVSAEQGVASLWRGNLANVIRYFPTQAFNFAFKDTFKRMFPRYDQKKEFWKFFCTNVASGGLAGASSLVIVYPLDFARTRLASDVGKGTDREFTGLVDCLGKIFRRTGFFSLYQGFGVSVQGIIVYRGAYFGLFDTAKAMLFGPNNDANIFYKWAVAQTVTAAAGVASYPFDTVRRRMMMMAGRKKGEQEIQYTGTADCWKKVYQQEGFKGFFKGAWANVLRGAGGALVLVFYDELKKMLM

SEQ ID NO: 18 - protein, 594 aa, Neospora caninum
MEQSASVGPSSCLVRLAGALLVLALCHAQRGAGILLPQSWDDSEAALSVSPVGGLMGEHRTASAEQANFVAEEQVEDKRGGSWLQQEEVEQVPSEAQNQTDAEPGTQSSTRFGRLLARLRWRGRGRGGSAGAAQEQQRRRVPLRTRLLQHLKRGVRFLRHDIPAAAARLYRRLRPGQPRLFPVDEVPSDVETNPMYYHGRDSGDVILEELFKRIPEAGQPIIYREASAYDDLVSRMLWRNQKHFSVVSELGEPSRTLIRGRMLGKGPSAIVFEATDRETGETLAVSVPYFTEKPSAMDIEGLRDEVLCINLFPNIKNPKQAQTYMRLLVPTDIVRARLTRLSRRGLVGQSRIWIVNRYFLYPLMQTNLISLIEGLSRSSDVNSNLAIHARLQLTVQVIKLAASLHHHGVVHGNLQMSSIFIQKNGAVFLGKLRYMVKEGEYSEFTFGRGFEPPETTDPSRQGRSYDPRKHKRYAFDAWAVGLAIHWIWCEDLPDTESAPLGGTEWIFKRCRNIELSEPVKFLLEGFLRHDPEDRLLPLQATETPQFENIKEMISSVLNQYDQQGEPKLWGKGDLPTSGTTQGDDGVDETEDTRL

SEQ ID NO: 19 - protein, 1123 aa, Neospora caninum
MLGGVTSRVGTTPGITEFTSSFNYGERTKGFVLFRERHGYDLAVCRYIRGGNCKRYVISSRNRQSKRYTKRSSPAISIPCDSNDGSFNFSPLSGGSPLNVASLDNIQVQDDPLAQALEDAKLIGELVDQAKNRRSDLAGTVDEFIVRGQNLTAQLKQALKSWDHASVKRTEKAFRHEYANLRKVYASVMNVQQEMQRDLNRGKELLAHLGTTAKKLLDNETLKKVLRMYGTQLQNEVMASERERGSTEAFISQSNEVMNQLQKEFYDGMASLEKHKEILQKIEALGSQVLDIDHVREQMQTILTIAKEIKARSADAEKDSKRGLVRVDALSHACTRSEMETKTASNRLQEIKTTLLRKLDDLENQLKGAHSSQGVRVAREALEAMRGRIQQSADSAAAIGQECNTTVDEARAHLSRCKKRNAERIRTKISEAQWLLQRTNSLVGQSQSDSLGRLERQLEESTTQLKELAPMVDNNFEDFPRISAVALAAERAAAALADFEKNFKASAAQLQEAHQLMLRELEELQNACDAPQSRLQIGSVVTELKRSFSSIDSFSERVSSPEIRNDFKLSLLAFLRRPLSSAAGNIDDAKRQEALVTDLSKRMSEEVAAYRRVIEDTEAEAEKVLRKHKQKGSHNGANALPEDPAVWNEVLQLRRKQIQAVNRLTTNAEAAKVKSDIGVAEMEKEIGDTRRMIEALRECLANKGVVAAIDEIGRPGTQGKNSTELLHEAELLEKKADQLQIQVQRSKDAVSEREKLLDAERKKLLETGSEFIPHFLQLLKKAVDEALKEGTQLEAMVVHVERLAHNSKARRAEDVLIPPPTDGSVTNEEAAAEAEMDADSFFRAASTQNDKLQGKLKEYHNRLSVRHSDVDEAKALLQALLPQSREVDQRQSSGRRLSSSKILTEQQLGEYSQDLVILEEILTKEEQKIRDIAERGRKAIADAARAAAADTHPENEQPPQEANKDSGPSQGLLLGIGLGIGIPLAIASIAMWRCYGRKKKPGVGSSIAPSEDRATSAESGGSDTSRRARSTGPDHLESIRISTLEFGDLETAFSGVEHPEIAGIVARETLPTPPAGEPDTTHMQYMIDDHYTVARNISKEVEHKFDFEGFPTAVVREQRPQSE

SEQ ID NO: 20 - protein, 1226 aa, Neospora caninum
MTFLSFFKCAKGTNGAHKETDVVENFFQTQASSQSHLFSPQLTDEATPNEVARRHFRPVLPPVFSSPSGIVTVPCKDTDLINKQDEVNNAPHVLSQGDHEILAGLFPNTINTDFCLLTAASGDLRPPSEPLRVGVVLSGGQAAGGHNVICGIFDYVKRVNPASTVYGFLGGPHGVFSHEYVELTEAVIDRYRNMGGFDMIRSGRHKIETDEQKQKSLEICEKLQLNGLVVIGGDDSNTNAAILAEYFKSKGSSTAVCGCPKTIDGDLKNRFVEISFGFDTACKTYCQQIGNLMRNAMTGGSTYHFVRLMGRSASLITLECALQTHPNYTFIGEEVLAKKQSLRQLVEALVDLVEARHAQGKQYGVVLLPEGLIEFIPEVGVLISEINHIVAEGDFEVSKLTPESRAVFEELPDSTRQQLLLDRDPHGNVQVAMIHTEKLLMQMTEAELHKRQFKGTFLAQSHYLGYEGRSGYPSDFDATYCYGLGNVAGALIQNKVTACMAVLKDMSASPNPLDWKAAGIPLTKMMNLETRKGKANVPVIKKFLVDIERPLFQTFAQVRDAMRLQDVYQIPGPMQLNTPTPVLPFTLVGAPSAASLLSSSSPQSLGHDRLEFDALVNPLLLQKETTVAPAGAAHASAEACKAHIEALFPALGAETKDFLGGACKLQKAEKLKEKCSVGVVLVGPERPGYSNILCGLVQRVALVGGTVKGFKGARGLLTNDCVVVSEKDAATQRNQPGFVLLGRTEDAESELFTKEGLKKAAATLQAAGVSTLVMIGGTTLHAAALSELVASQGQATRVVCVEPSGDLGRFPACGALQLLKEITGKDIVVGSSDAKACPGITSTFQQLAGCRGLGFDTETKVASEMIANLLTDSNSAAKYFYFCQVSGGLDAECEVGLQTHPNFVLSSAQCKTKTLGDMVKSVADAVKARAALKKNFGVAVINENLFALNKELRHLALEMHLHFLAHPPTPATGVCLALTAEEEAGLTAALSPASRELFASLPVAFQHKLIRDIEVQKYPKAILRFPAHEMIAAMVAATLKKEKEAGTFTGSFSPLCFEFSDSLRASYPSLYDCSLGSTLGHLSAICATTQALPSHAVHVSVANPTSSPTIFEPLVMPLAAAAAQVHRLAPAASPSSVSETAVNGVFSVAEGDALFSLSDSAAEGVVSQLVSQGMQGGWVEAEKYCNPGPLQFREPAKDYYYSRALFETLKGAMRGEACGAAACRDQ

SEQ ID NO: 21 - protein, 568 aa, Neospora caninum
MTIHSCLARRAVSAAANTARALSASQALSLRALALGSLQSAGRHIHTSNVRAAGAKISPSEMSKLLEERISGWKAQTSTEEVGRVVSVGDGIARLFGLEGVQAGELVEFQNGMTGMALNLETDNVGVVIFGDDRSVLEGDSVKRTGRIVDVPIGPGLLGRVVDALGNPIDGKGPIPAKERRRVELKAPGIIPRKSVHEPMMTGLKCVDALVPVGRGQRELIIGDRQTGKTAVAVDAIINQKEINDSTDDESKKLYCIYVAVGQKRSTVAQIVKALEQRDAMKYTTVVAATASEAAPLQFLAPYSGCAMGEWFRDSGRHCVIIYDDLSKQATAYRQMSLLLRRPPGREAYPGDVFYLHSRLLERAAKMGDKSGGGSLTALPVIETQAGDVSAYIPTNVISITDGQIFLETELFYKGIRPAINVGLSVSRVGSAAQVKAMKQVAGTMKLELAQYREVAAFAQFGSDLDASTRQLLTRGTALTELLKQRQYSPMKNSVQVCVLYCGVKGYLDPLDPKEISRFESLFIEFINANHQDILKAIETEKELSEKTEAKLRAAIDEFVAMNEFKKK

SEQ ID NO: 22 - protein, 425 aa, Neospora caninum
MGPWVTDLGSPVKRSELTEGQEDMRKLTATVVSGEMEKNRKQYLREEYALENLYFDGFLSDEDLREKTNDVEVAFRNAFPSGSVYNAVDNEGKRTRLGLGKILGSGGTAVVCIVQDMQNLAMARNYAGKFFVLSLDSTAPQDMEQRENKLDVTWRMHQASNERLLNQASIDELLTNGIAVSQHDYTLESTHPQREKLPDVIVGKVGGKSRKRLLIKPHVSLMPLLGPSLSDFWSKAFTDNALKYLVFNLVTTVSYLERINLVHRDLKPANFAVDSNGRVFMIDLAFVANIGENVSCSGNLTLHYVDPIRAKCGANGGRGAKASSLMDSWSLGATIFSIICNGKKPFKFRTPRGRGDKGENTRAYYEEFLKKLKRENFAGGRCDFMTPERRKLLDIVKLLLDPQEETRWTALRLKNEHPFFQVEED

SEQ ID NO: 23 - protein, 520 aa, Neospora caninum
MEKSYRQTGACLDNPCAVLRTPVEEDWAQIRYILNVVAAGDGPANPDQLANLHKRLLQLTGNLRTENRPIRQDALLKYLESNSRKFFSHDLPLLAALVSRLDDFFPSGLQFITPENPQVHLRKIQALTLIAAAFLGVIPHNQRALLEHHPKKFKMNLNKFDMFYRGFMEREAKFKSVLMYFESMRERLGDCWTEMVKTDSVLTAPCTSVCECSRLVDGTSIAPTDELIGFYRQTNQAVDFVWRGGSVTGTSMAVSIDDIARSTKPLGDFNVLPGRDLTFADGDLQVDFADQYLGGLSMFENHIAQEELIFITYPEMLPVMLFSDIMKANEAVIVKGVERFVFSRGYEWSFKIEQAAGRWSKLLPGKHHSVQGVVPLDSLGRRDVTIVGMDAVQFFDKDKQYSQKMVDRELLKATVGFKGDPYEATVSRSHKAVATGLWGCGVFNGDVELKALIQWLAASYLGRAVNFYSPVVKYQKNMDHVISKIGRTYSTVADLYNAIQRAVKRRQVGSSRWSLWEQLV

SEQ ID NO: 24 - protein, 847 aa, Neospora caninum
MVSEAPGVPSSPSTEVRTAALKAWRAWRKDNKGPLEEVLQNPAGYSLYKAMKASSGGPVPNTFQQWLQQNEHAKRWLTWRQGCPGQLRDVLADPEGWRLFSTMKREKGQPVPETYEEWRDLPEHKIVASRRTWSAWRRAHPGPLAATLADPEGWALYRQIKVWDGKDVPERYEDWVSHPTVRKQAAMEAWTQWRHEHAGQLSKVLADPQGWALYKAMVECGDKRIEATYDEWMAKRDASPTSWAVWRKSHRGPLNEVLKDPAGWAAFTAYNTKKGVSLPATYEEWVQLPEQQKGAASFKWSSWRKAHKGPLAEVLADPEGWALYVNMLEKGSHARVRSSYSEWLEAYRAAKSPGSSSAQWRQWRKAHEGPLEEVLADPEGWKLYAAHMQRGGRRAFPSDFTTWLEAHQAEAKWTEWRRAHAGPLNRELADPEGWELFRMRSSARGNAAVPATYAEWMKLPEQQAFVAVEAWGAWRQAHPGQLKDVLQADGNGWILYRTMLRAAGIEVPDDLAAWLQDSGKYVKLAWQSWRDKHRGPLRRVLADPLGWLLYKSVVESSGASIEETFEAWAQSKGPSGNEWINWRRLHKGPLHEVLRDPEGWKLYRENLLRKNVSDVPQTFEAFLQQPDQQKAAATSKWSSWRRVHRGPLVSVLADKEGWELYVNMMEKLGHKICSSFDEWCSSAQMHKGRAAREWRAWRRLHKGPLVNVLADPEGWALYKAWTAGSSNRVAHESYEEWCLQKEKGREWREWRAKHPGQLKTVLAEGEGWELFKKYNEARNRPVPASFADWLEQQQQEHQVEKDAWIAWRKNHTGKLADVLADPEGWQLYRRMKETAREPVPASYAEWL

SEQ ID NO: 25 - protein, 1915 aa, Neospora caninum
MKAGRPVTAGSPGPKAASLARRRSGVAGCFSRASAAFKRLRRYLTVSSLSLVVLLFALCYYVVQRRLLSASHLSFVAEGPGMHPGFNVPSRFFSLSLHSDKGALTEGEKQALSSEFSVSWSTTPRLPGGAKLSSQVVSRQDGTFLFRFSLHDAIPAGHTLSGKVLYAGKKPDRSIVEPFVFKMEGPIHPATCRCPENADAWKQALSCPRTLPRQLERDISKFPVVDLARLRKDGPAFAAPNTLRTVVHYVVKDNQIFRRHFGPLPGFQYFIDNVLLYLAAAVKLPDVEFFMNLGDWPLEKRNADEGGLPLFSWSGSDDTFDIILPQWDVAKTSTVGLGKSQPDLLTIQARSGEPLAKRIPKALFRGRDSNSLRVKLAELAQKHDILDVAITSWENDTYAEQEKKLGGGYKSRIPLEKFGEYKYQLLVDGSVAPFRTPYLLMTGSLPLKHESRYYEWFYGDLKAGVHYLPFKNDLSDLVDQLKWAEEHPVEAQAIADRARQYAQEHLVPNKIFCYYFQALEVYASRQKGTPTVADDMVKVDPTTAPPRCACEAEPRKDANRPYPLVQLYSGNIANVLEKEKVVVIASYSSFCNKSSSFLPKFLKAARAFADKKAPVTFALADGLTNRYPEPFDFCNYKSQPRVLVLPPGHDREKVQVMEDALTVYNTVEFVAKHVAAEFRPTVPEDLAEVMSQAVPEDNSKPVKVVVGNTFDSIVFNEEKDVLLEIYAPWCGHCKNLKPTYEEFARLASLSPSAKSLVVAKMDGTENSTRHKAFSWSAYPTILFIKAGSRTPIPFSGPRTLRGFYDFIVKHGSNPALDIAGIPPPEVDVFSGPSAATVVNAANFDKIVNGDKDVLLEVYAPWCGHCKRLQPVYEAFATAAAKSPSARAHLVVAKMDGTETRPSQDDFKITGFPTIWFIKKGSGKPIKHTGGRSARDLLKFVQEHATSKIEVELPPEEPPKPLSQSVPTDNSGPVKVIVRNTFEKEVLQSDKDVLLEVYAPWCGHCKKLEPVYEAFAREAAKSATAAKNLVVAKMDGTQNTLDNPEFKWTGFPTIWFIKKGSGKPIKHSGGRSARDLLKFVQEHATSKIEVELPPEEPPKPLSQSVPTDNSGPVKVIVRNTFEKEVLQSDKDVLLKVYAPWCGHCKKLEPVYEAFAREAAKSATAAKNLVVAKMDGTQNTLDNPEFKWTGFPTIWFIKKGSGKPIKHTGGRSARDLLKFVQEHATSKIEVELPPEEPPKPLSQSVPTDNSGPVKVIVRNTFEKEVLQSDKDVLLEVYAPWCGHCKKLEPVYEAFAREAAKSATAAKNLVVAKMDGTQNMLDNPEFKWTGFPTIWFIKKGSGKPIKHTGGRSARDLLKFVQEHATSKIEVELPPEEPPKPLSQSVPTDNSGPVKVIVRNTFEKEVLQSDKVYAPWCGHCKKLEPVYEAFAREAAKSATAAKNLVVAKMDGTQNTLDNPEFKWTGFPTIWFIKKGSGKPIKHTGGRSARDLLKFVQEHATSKIEVELPPAEPPKPLSQSVPTDNSGPVKVIVRNTFEKEVLQSDKVYAPWCGHCKKLEPVYEAFAREAAKSATAAKNLVVAKMDGTQNTLDNPEFKWTGFPTIWFIKKGSGKPIKHTGGRSARDLLKFVQEHATSKIEVELPPEEPPKPLSQSVPTDNSGPVKVIVRNTFEKEVLQSDKVYAPWCGHCKKLEPVYEAFAREAAKSATAAKNLVVAKMDGTQNTLDNPEFKWTGFPTIWFIKKGSGKPIKHTGGRSARDLLKFVQEHATSKIEVELPPEEPPKPLSQSVPTDNSGPVKVIVRNTFEKEVLQSDKDVLLEVYAPWCGHCKKLEPVYEAFAREAAKSATAAKNLVVAKMDGTQNTLDNPEFKWTGFPTIWLVRKGSGKPIEFNGVRTVDGLREFVVEHASVSGMFDSTRDEL

SEQ ID NO: 26 - protein, 1941 aa, Neospora caninum
MTASSLDGASPTGGGDQGDEEVRCAVGTKIYVSDPADVWKTAEVVKIQEDGSLTARVDADNELVHLRKGDLWYLCNTDVWNTTGLSAPTDLTMLTHLHEAAVLDSLNLRFDIDEIYTFTGPILIAVNPFKQIAGLYDMKPHVFASSSAAYEGMCNEKQSQTILISGESGAGKTESTKFVMKFLACAGSDDLERRSQVEAQVLESNPLLEAFGNARTLRNDNSSRFGKFIELQFQTNKTKRVSGNRGRLCGARIQTYLLEKVRVCDQQEGERNYHIFYQLCAAAEAAAQKGGIYYFPSPKFRKAADAKPQEMDMSLFEPRDKFKYLTKSSCHALQGVDDCEEFDSTVFAMQTVGISPEEQMNIFSVVGAVLCLGNVSFETPKGNSEGSQVAPSCAEYVSKACRLLGVESDALQEAMCYRTIKTMHESYRKPLKTDEAWEMKDALCRALYGCLFLQVVARTNQSIGYLTEVKSPDDVLLFCGVLDIFGFECFAFNSFEQLCINFTNERLQNFFNTFVFKCEEELYRAEGIQWNPLDFPDNADCVALLQDKPLGLFSMLDEECMVPAGKDRGFNNKVCQKHTGHKRFGVIKTKPNCFVVHHFAGSVEYCSDGFLEKNKDQLSLDLQEAIKASSIAFVSHLFTAFLNRGASEDGASVGKKRKFVTVSSEFREQLGSLMDTVNKTAPHFIRCIKPNPQNLPDLFDRVTVNEQLRYGGVLQAVQVSRAGYPVRLSHRDCFFDYKALADKAVLEKLCMQSEGTVSSETWRERAQALLLHLDAKLNLDRKKKDAPSHDKTWAVGKSLCFFKNEAYEVLSASLMSVRVQAATAIQARYKCFVQRRFFLMYRQTVVFLQSHVRMFLCKLEAWRRRQDRAAKRIETFLRGAVARLRYLRTLKQIKTIQAAWRGKQTRSKLRDLQLHEAAGKIQATWKMHRQRASYRDLRKAATLAQLKWKRILARRMLRRLREEAREVSGLLKKAQDLQRDLGEERSKRSEVESHVLQLQAKNEELLKEIQRLHKELDRAKEEVASLQASNEDFASQVKQLKESLTAGSSTPSTPQMTPGTQKRRLSNHADAQQSQGDRLSTQTDEELKALRQELEKREAEAQLQQSEHETLIAKLQASLKEAESALEQEKTQRSEAEARYKLVLEDSSASSTHFRLSSAGAAKQQPGSSLASGEAGGVSSTLLREKRNKVPDGDGALAATKTLSPLPSVALASEHWECVLHDQRWIDLLLLGPAGVGKTGLLEQFLIKLGDEVHLEQLRVSRKMEDQAPFSKLPQHYELVYPRDSEDAPTRGAKPRDDELTRVNVLDFPGPSRTKQNPALRVKQAFVVAVVYDPTRPETCDEALQVLTNVVLPCRPKVAAQDGLAACVSGRVYLVENGWRVAAREGTVQVDTAAIRDKGTSTAGLRCHYRELVHLESLVDEIVPLMAEWRGMLQQQRLAMLQHHARLQPGSAAGLSPFALPRPPAQASRGASLSFSNAAHAAGSGLRENGAEKSPSVSGSASGTHRQGSLSANLFDSIRSFLSQSSMRPGPGSALASGAKQSVDSKLLRPSMKPGGSAMLKKLKSRNMDAHSVVPVQELQDSDSAITCVVFGKEKDNRDYILLAAASKDGSVVIYRCYRLEAERQMFDQEQVSLLVAPASKPPGDNREHFGPSVSVHSRLVGHSRAVTCLFFSLLEDQLVTTSIDKSVRFWHVDTGDMLKVFTDSSPALAAAFLPFNPTAFVASNSNSILRLVCATSGRVIQKLKVESEVRALKFDDTGLFCFAGTKAGAVHVLEASDTINIRFKFKTTLGKGAVTCITFVPSTGPGQYPRLLINCCDSSVAIVECIYGPPPGVLTNLLVRHRVRIAHSLLPLRCWFSNFGGGWLITGSEDKDVYCFSLQQGANFKAISLKHHQAPILAVATNLQDTLLVSADSMGKLVLWRSLDFSGAADASAGARGRAV

SEQ ID NO: 27 - protein, 449 aa, Neospora caninum
MREIVHVQGGQCGNQIGAKFWEVISDEHGIDPTGTYCGDSDLQLERINVFYNEATGGRFVPRAILMDLEPGTMDSVRAGPFGQLFRPDNFVFGQTGAGNNWAKGHYTEGAELIDSVLDVVRKEAEGCDCLQGFQITHSLGGGTGSGMGTLLISKVREEYPDRIMETFSVFPSPKVSDTVVEPYNATLSVHQLVENADEVQVIDNEALYDICFRTLKLTTPTYGDLNHLVSAAMSGVTCCLRFPGQLNSDLRKLAVNLIPFPRLHFFLIGFAPLTSRGSQQYRALSVPELTQQMFDAKNMMCASDPRHGRYLTASAMFRGRMSTKEVDEQMLNVQNKNSSYFVEWIPNNMKSSVCDIPPKGLKMSVTFVGNSTAIQEMFKRVSDQFTAMFRRKAFLHWYTGEGMDEMEFTEAESNMNDLVSEYQQYQDATAEEEGEFDEEEGEMGAEEGA

SEQ ID NO: 28 - protein, 595 aa, Neospora caninum
MRALLLVPVIACSQQSSIWFAVARRHGGQQLRLGVPEFRPLFAQMTIGGDEPSTTAAGSEDANYDLSCLHSSNVGSKAATIGDPLPTGSAKQCALVCREVTECNHFTYNTQAKMCYLKSGKPDLYSYPGDMTAPRSCDTTCFEKGVSYDKAPDVMNPISASQAVDCQAACAADPRCKTFTFSEPDKTCSFKGRGFSAHKQMKVAGVTSGPAQFCDSGGDLRRDSVGDLRRDSGGDLRLQEQADQLYGCVHTEDVGSEAPNLSDPKPATSMEACMKRCRSEGKCTHFTFNVTAGMCHLKAGKMQLYPYAGDRTGPKSCDTSCFWREVAYAKNQLSDLGSAYQILQPTDCQALCAANPLCKVFVWDYFEKTCAFRGKGFLKHKKPHAVGAISGPREFCDFGGNMHQREEADAANTDDPVDAARALPNAADHHQDLLCVHTGNIGSKAGDIESPQPANDLTECMARCKATKKCSHYTFNTNSKYCHMKSGKPKLYEYPGDLTGSKTCDTSCFRRGVDYSTAPGVGKPWFTTLATDCQVACGAEDGCVAFTWHAPTSRCYLLTAGFSKHRRDGVEGAISGPYTFCDDSENLQVLEEEDA

SEQ ID NO: 29 - protein, 398 aa, Neospora caninum
MSHRKFERPRHGSLGFLPRKRCKRHRGKVKAFPKDDPSKPPHLTAFMGYKAGMTHVVRELDKPGSKLHKKEIVEAVTVVDTPPMVCVGVVGYIETPRGLRALVTVWAGHLSDECKRRFYKNWYKSKRKAFTKYAKRYGDNNKMEAELTRMKNYCSVIRAICHTQPSKTPIGSKKAHVMEIQVNGGSVAEKVDFCTKMFETAVPVKAVFTEGEMLDVIGVTKGHGVKGVVSRWGVTRLPRKTHRGLRKIACIGAWHPARVQFQVPRHGQKGYFHRTEMNKKVYRVGNGADPRNATTESDLTEKRITPMGGFPHYGTVNNDFLLIKGCIVGCKKRPITFRKTLVTRTSRKALEPVNLKFIDTSAKWGHGRFQTSEEKAKFYGPLKSRAPVILALLEAARM

SEQ ID NO: 30 - protein, 763 aa, Neospora caninum
MATASPVVAPSSPASPPAQPSPMPVAPNAGADGPAAGAGHQAAADHTAGNANVSGGGVSGTAPPAGQRPNGLNAAASAANFVSPSLYVGDLHQDVTEAMLFEVFNSVGPVTSIRVCRDTVTRRSLGYAYVNYQGIQDAERSLDTLNYTVIKGQPCRIMWCHRDPSLRKSGNGNIFVKNLDKNIDNKALYDTFSLFGNILSCKVAVDENGHSKGYGFVHYENEESARSAIDKVNGMLIGGKTVYVGPFIRRAERDNLAETKYTNVYIKNMPSAWEDEARLRETFAKYGSITSLVVRKDPKGRLFAFCNFADHDSAKAAVEALNGKRVTDAGAIKEGEDSGAEEKDEEGQKREGEQILFVGPHQSKAHRSAMLRAKFEQMNQDRNDRFQGVNLYIKNMDDSIDDEKLRQLFEPFGSITSAKVMRDERGVSRCFGFVCFMSPEEATKAVTEMHLKLVKGKPLYVGLAERREQRLMRLQQRFRLPSLRPAAALPGNVAAAAAAAQLQYGGAAPQLQGFAGPGAMYAPRPLMGFSPHPHQVTAAMLPWRQQQAGGQFASQGVPMRPQLGPLQHLYGQTNAAAAAVAAGMHAAAGGPPMQMLQQQQRGGHRGGMGRQGGAGPVLNGNKQHMMGPKPGAGQQQPQGGPGSFKFTPQVRNQRLDQQMQPPAAVPAPHNHHQVMMEQSQQLLMNPDAPLTAAALAAAQPSMQKQMLGEKLFPLIARYQPELAGKITGMMLEMDNAELLILLESEAQLKAKVDEALRVLQQAS

SEQ ID NO: 31 - protein, 606 aa, Neospora caninum
MFQKCADACGDCCQPADQQRAHATLPPHVVLTQNSDSPTVRMAAGPTSPSALQQLHATQESVRSVTLEERADRSRTVALAEQTDRQWVAITAYQPIDTVTKTVEVPVVRTVETYVPKVVVEEKIVEVPKYVPEYVEKVVEVPEVQYVDKIVEVPEYQYEYKYVPKVETKENIIQRPKYETKYIEKVVEVPQVKEVVRYQEVEEVEEIIRYVPKDSVVPEEWKRIQEEQDKREAELKQKEEKEEEELKGLLDEERKLHEERMQQQIKIQQQIIQQQLSARAEQERLLKQKCESEAVHFPVVEGAPPLPAIPKVEQVFKPKVIKQVEIQKHVPISVDVPVPYMVPKPVVVSVQVPVLKFRDHFVPVPVRRRVVPRIRWTNEVYEVECIKEKPFLQVQDVIKPVPCDVEIRVHEFVDRAAPINPAELSQADIHAMWMRVNADLAEKRKQELGDKYPYVKHPAGTVFGEPGCSAEEGEEQSSDAEAEGGAPSGAEPLALHPGHPLNMTYLQNEWIKKSTVSTHEMYTPEWFEAHQKALFNLTMQHPTQVQLSAEQAAQLQQQEAQFGDAPWVEEARAGATVKVHEPDVQSAQCCAICAVCGDGGACRCQC

SEQ ID NO: 32 - protein, 986 aa, Neospora caninum
MKALTGLVLSRKGNSVPSPWSGVSAPLAQPSIARNSRALLAKACSLSSSHAVGEQKRRSGNLSDSPACGSRNARLYASLSQARNMSTKANPYAFAAKTLEGTQKTYYDLGALQDDRLKTLPFSIRVLLESAVRNCDGFSIKPEDVQTILDWQKSSQAQKEIPFMPARVLLQDFTGVPAVVDLAAMRDAMARLGGPPSKINPLVDVDLVIDHSVQVDYSRSPQAFEKNLAKEMERNSERFSFLKWGSTAFSNMLIVPPGSGIVHQVNLEYLARVVMDKAKNGNRSLLYPDSLVGTDSHTTMINGLGVVAWGVGGIEAEAVMLGQQISMVLPQVIGFELTGQLSPSVTATDLVLTVTNILRKKGVVGKFVEFYGPGVKTLTLADRATVANMAPEYGATMGFFPVDEQTLRYLKQTGRSDEKVDLIEAYTKANYLFAGQGAHEAIAFSDRVSLNLSEIQPCVAGPKRPQDRVPLNDVKEDFQVSLRNPVGFKGFGLADAQAEKKVEMTYQGKTYTLTNGSVVIAAITSCTNTSNPGVILGAAMLARNAVQKGLSVPPYIVTTLSPGSQAVTEYLARSGLLTDLEKLGFYTAGYGCMTCIGNTGDFDPEVSEAITKGDLVVAAVLSGNRNFEGRVHPLTRANYLASPPLVVAYALAGRVDFDFENEPLGNDSEGKPVFLRDIWPSRDQIAEVEAKALSASAFVKIYEHITEGTPAWNALKTAKASDLFEWDEKSTYIHNPPFFQTMGKEPSPIADIEDAYCLLNLGDSITTDHISPAGNIAMNSPAAKYLQAKGVERKDFNTYGARRGNDEIMVRGTFANIRLVNKLCPKDGPKTVHVPTGEVLPVYDVAMKYKAEGKPMIVLAGKEYGSGSSRDWAAKGPYLMGVKAIIAESFERIHRTNLVGMGIVPLQFQEGQNAESLGLTGKEQFSISLNKGEIVPGSLITVKTREGKTFDVRCRIDTELEVKYFQNGGILHYVLRNLVKQHAEGH

SEQ ID NO: 33 - protein, 376 aa, Neospora caninum
MADEEVQALVVDNGSGNVKAGVAGDDAPRAVFPSIVGKPKNPGIMVGMEEKDCYVGDEAQSKRGILTLKYPIEHGIVTNWDDMEKIWHHTFYNELRVAPEEHPVLLTEAPLNPKANRERMTQIMFETFNVPAMYVAIQAVLSLYSSGRTTGIVLDSGDGVSHTVPIYEGYALPHAIMRLDLAGRDLTEYMMKILHERGYGFTTSAEKEIVRDIKEKLCYIALDFDEEMKAAEDSSDIEKSYELPDGNIITVGNERFRCPEALFQPSFLGKEAAGVHRTTFDSIMKCDVDIRKDLYGNVVLSGGTTMYEGIGERLTKELTSLAPSTMKIKVVAPPERKYSVWIGGSILSSLSTFQQMWITKEEYDESGPSIVHRKCF

SEQ ID NO: 34 - protein, 938 aa, Neospora caninum
MASGIATVKEVVSGDTFVLVGAPKGGPPPEKRLSLASVQAPRVAMKSLSHELQDEPYGWAARECMRNRLIGQQVEFKVDYVLSNKEYGTIKFNGENIACSLLKQGLAKLKPNRNPPCAPDIEELEQCQDFAEQRQLGVWAADPAAGSGTVREMKWAVNDTAFVKAFVAENKGKKLPGIVEYVRDGGCMRVALLLPQKPGEPLKVVYLPILLSGIQCDGFKREQQEGSTEFKVVPEPYAVEARFFVEIRLLNRDVEVRIEGCDEYGNVNGTVYHPKGNISVLLLQNGLAKIQTGTLSLTECASQLSQAMREAQQKQLRKWKGWSSSTSAVASKNYMAQVAEILSGDSVVLRLPDGSERRVYLASIRCPRAAGVGKTASREEESIAFETKEFVRKKLIGKNVKVFVEYLREPLPSASGAALPPASDDQGRMHFVSLWIPNSPKDTDPTQTKNGQNIAELLLQAGLAKTIPHRADDERAAEYEKYLELEQVATQQKKGLHAPPQQWKVHRIIDLLGPTNAQRANAYFQQLERIPKLDGVVDHVFGPGRFKIRIPSQNIAISFVLGGLRCPQTAPRPGSFAATARPGKAREAEPFGEEALSFSRARVLQRDVQVKVESVDKGGNFIGNFWYGQGKQNLAVDLLELGYAHTVDFSLARCSLRELLTAAEAKAKAARMNIWSLPGALEAEENAAKEVQVDEVLPHVTVTHVEGVDSFFIQDPSSADLQSVMSTLGKYGAEGSSNLDDTYTPGGLPRKGEVVICKFSADNLWYRGRVDARDSSGKEPQISVFYIDFGNRETLPLHAVRRCPDAVATSKFPPQAKQCCLSGLLPPPEMEFEAASYLDEVTQNLVFQCKVEKIDIQKRRHCILTPQEDLGTGKTGNTVNEKMLRKGLACLDKKSNTKYFHRFQVEEEAARKAHVNVWRYGDCGGDDEEDYPSLNGRG

SEQ ID NO: 35 - protein, 259 aa, Neospora caninum
MAIGKNKRMSKGKKGGKKKIGDPFLKKEWYDLKAPTLFNVRNFGKTLVTKSQGTKLAVDGLRGRVYEVNLADLNNDEDQGFRKIKLCCEDIQGRNCLTDFHGMDMTRDKICSLVRKCHSLIEAFVDVTTLDGYTLRMFCIGFTKRRPDQVKSTCYAQTSQIRAIRKKMMTIMSAEASKCQLRDLVKKFIPESIGKDIENACKGIFPLQNVFIRKVKMLKKPKFDLTKLMELHGEVEDVGRKVQAESGEAQNTLTAETKA

SEQ ID NO: 36 - protein, 449 aa, Neospora caninum
MREIVHIQAGQCGNQIGAKFWEVISDEHGVDPTGTYTGDSDLQLERINVFYNEATGGRFVPRAILMDLEPGTMDSVRAGPFGQLFRPDNFVFGQTGAGNNWAKGHYTEGAELIDSVLDVVRKEAEGCDCLQGFQITHSLGGGTGSGMGTLLISKVREEYPDRIMETFSVFPSPKVSDTVVEPYNATLSVHQLVENADEVQVIDNEALYDICFRTLKLTTPTYGDLNHLVSAAMSGVTCSLRFPGQLNSDLRKLAVNLIPFPRLHFFLIGFAPLTSRGSQQYRALTVPELTQQMFDAKNMMCASDPRHGRYLTACALFRGRMSTKEVDEQMLNVQNKNSSYFVEWIPNNMKSAVCDIPPKGLKMSVTFVGNSTAIQEMFKRVSEQFTAMFRRKAFLHWYTGEGMDEMEFTEAESNMNDLVSEYQQYQDATAEEEGEFDEEEGAMDADGEA

SEQ ID NO: 37 - protein, 453 aa, Neospora caninum
MREVISIHVGQAGIQIGNACWELFCLEHGIQPDGQMPSDKTIGGGDDAFNTFFSETGAGKHVPRCVFLDLEPTVVDEVRTGTYRHLFHPEQLISGKEDAANNFARGHYTIGKEIVDLSLDRIRKLADNCTGLQGFLMFNAVGGGTGSGLGCLLLERLSVDYGKKSKLNFCSWPSPQVSTAVVEPYNSVLSTHSLLEHTDVAVMLDNEAIYDICRRNLDIERPTYTNLNRLIAQVISSLTASLRFDGALNVDVTEFQTNLVPYPRIHFMLSSYAPIISAEKAYHEQLSVAEITNSAFEPASMMAKCDPRHGKYMACCLMYRGDVVPKDVNAAVATIKTKRTIQFVDWCPTGFKCGINYQPPTVVPGGDLAKVMRAVCMISNSTAIAEVFSRMDHKFDLMYAKRAFVHWYVGEGMEEGEFSEAREDLAALEKDYEEVGIETAEGEGEEEGYGDEY

SEQ ID NO: 38 - protein, 385 aa, Neospora caninum
MGNACECQKADTVQEESPAAPVLTKVTKGKGTTGSSSSGQKTSGTKAASSNSSTVVPQLTEDDLDTEDEKDDDVVEDMPQPSEAYMSRAKNRQSVSAEAYGEWNKRKKFVAPVYPKTAEQKERITKVIESSFLFSSLDIEDLEIVINAFQEVSVKKGTVIIRQGDDGDRLYLIETGEVDVMKKFPGEKENKFLCKMRPGDAFGELALMYNAPRAATVIAADDMLLWALDRDSFTNIVRDAAAKKREVFEESLKEVRILEDMDPYERSKLSDALRTATYEDGDVIIKEGETGDTFYILLEGTAEAIKNDKVVMEYKKGGFFGELALLKDQPRAATVVAKSHVQVAYMDRKSFKRLLGPVEQILMRNQDNYRKAMEQLGLDTKYLDK

SEQ ID NO: 39 - protein, 561 aa, Neospora caninum
MASPALQTWWRTLARLPGVQARSNHFGPRALGHGARSVSPAAMASSASLLSPRSSCLRFLSSAAPSAKKPASAGTTPPAGTNLGRITQVIGAVVDVHFDEQLPPILNSLEVQGHSNRLVLEVAQHLGENTVRTIAMDATEGLVRGQKVVDTGAPIQVPVGVETLGRIMNVIGEPVDECGPVPAKKTYSIHRAAPLFADQSTEPGLLQTGIKVVDLLAPYAKGGKIGLFGGAGVGKTVLIMELINNVANKHGGFSVFAGVGERTREGNDLYHEMMTTGVIKRKKLEDGKFDFTGSKAALVYGQMNEPPGARARVALTALSVAEYFRDEQGQDVLLFIDNIYRFTQAGSEVSALLGRIPSAVGYQPTLATDLGQLQERITTTKKGSITSVQAVYVPADDLTDPAPATTFAHLDATTVLSRQIAELGIYPAVDPLDSTSRMLAPEIVGQEHYDTARATQKLLQDYKSLQDIIAILGMDELSEEDKLVVSRARKIQRFLSQPFTVAEVFTGKPGRFVELPETIKSAQTILRGECDDLPEMAFYMCGGLEEVRSKAVKMAQEAAGK

SEQ ID NO: 40 - protein, 1961 aa, Neospora caninum
MDPGRRLMPTPLGGIARSALVSLAIAFQCLHGDFTLAAGPSPPRVPARGASLPKTYMAAPQVLPSGFELIEEVPILAKNKIEFQFQDGLSPVPAGTILFECDPATRGDATLRKLVAYMPTDANTPTFTPVFDKDHNAPIACGADIARQCFAVGDKGVLRPLKDKESVAVGSSTAVYELLPGNLGRFVSTSLSTLVARRTGTFLLEQLLGMSVGICEAPSPNVPVDFPALTGVEQVDPFSHSISPVSSLRPAAHLPAPLVKTGEEVEVCTVARQDLVHDGDDKVFLLRPRSEASTEDGAAFPVLGGPIVCMKSEKGETLAHLDQNIPVGGGELASAANLLTPVAVAGKSQPPTCDLGPDSHTVATLLLSVSTDPSHPVERGADGNVQKTALHHFTAPYVPSVNSSVIVEIASPVSWEPQALKAKCKIGASLAALQPHLLLKSEVPHGTPVECEVVHLAAFHSQGQLLMIAPGQRPGQGARPLLLPPGSILLNQEDGVPEGVFQVLVYDLWEADGLRAVLKQLYYRGKDLDASIPVYVQTEGSRTVAVGSFHRRKRIFTPFNGIDPTERSRDIETEAPFYYTSFYGLPVDVGFTNLKSGVGFSVKRTPEALLFLEDLLKTPLAPASQAALADLSPFTREAEDVLSRLHRLKGHFSRQKYAAHAPVVIPMLNGGLAAIAKRLQEADRMFLTVYPRSRGTRISDVQVRLNYLDNSQTAMTVILRLPMRLNAFLSATHLAPQVHRNLALLLEVIEDPHTPLEALLLGNSKFGVYAEAVRIAVKLLRAGHCRACADDEIERTTPSADVAEGRCGRCSARRMNDIVILDLHDIQPSAATMPTTGTWMKWNDETFLISLPPDSSAPIYRRYGIEFDLHTTLDLPSRLATRFKQYAGACMRSHLLRMLEPLFENPGLNKNCPALSKFAAALLRGLPFSEAAPLLESSKLLLQHVVGACNIPEASWAIDKCLDDDGDLLGYRRMPAMRPLGRTRLANIMRGMMSPVSSLHFLTAMATGEERIRTFPSGRLSTTALELSHDAQAVLRGTGDNPPPLPSYVFGPRSPLGAVAAAADELTGRRAILLISSFSEKPIKVLEELLGLNPRSSTAVPPPDSLLTKYQAPVLSSVDRTIFDRQPRQSVQDFISSCFTDLPEICAGAYNALGWPLWKVPSDDKELHAFDKAVNEMRVRLNREHMPERLRSDIQQALSDFDALPAEPEPPAPTPEPPAPTPDAMAREAHGQETLEDRKKETDEHQGQPDAKGDDLQAEQDAKADDEEPAAASTSTPQEPSKQGFTVFELPPADSLTAAGSRHGSLWGQGQMPNAFLGSSQAPTTTSRRLAWPYINKMLTAKNGPMTRMPSWVRTSDTCSCLDPELSNGCRMDSVKSTTDVVFRLSLLVPPAVERYISSQASSRQLEPPFAAFCASVGIFVSSWQQHLVAGGHEEKGGNMAHSTLAARLAQGHKYLLKNYSDDGSSDHKHWRERRRRFIAFQKHYLYRQCRALMVAAGNVAYAPYKSKSFPAASLYGGIANTLDTPFTDKERALHGLTVWSERILRRHRNILRRVGRAMLRRPPQAPKIGALFAAMHMSHLFKDCFNMAGGILLRTWYYMHVEGSKLLAEAGRLPGVGSMLSAVSFGFAGGVDVRDSLFAPAFREISKVVTPVWESDSLFTSLAAYTPGGAVRASQRRSIKSTSSGGAEGENGKGQASRSESGSAENLLDPEKVIGEGGSMPVPASLRKSSSDDSSSFLSFGEAVHDEEEGASGPAKGSRIIASFRYNPKTFSDPNRELMVVDVPVPISAVERRSLTSFTSDGVLRFIQQKLASLHSQLKVRGGKSENGPLSLVQFQKQAGRIAGEEKAVEAAGSRKAAATESNSNKQCHEQTWESSLVGFLADQLDKDLKRNKGTSTSYLELGHLSLPTFSAGAFISRAMRDGSADTVVAVQMPEAGDDSHLNLEGSTLDFSRPISIGHM

SEQ ID NO: 41 - protein, 592 aa, Neospora caninum
MAQIREMIELPLRHPTLFKTLGVKPPRGVLLYGPPGSGKTLIAKAVANETGAFFFLINGPEVMSKMAGEAESNLRRAFEEAEKNAPAIIFIDEIDSIAPKREKTNGEVERRVVSQLLTLMDGLKGRGQVVVIGATNRQNSIDPALRRFGRFDREIDIGVPDDNGRLEILRIHTRNMKLANDVKLEELAANTHGFVGADLAQLCTEAALSCIREKMDLIDLEDDTIDAQVLNSMAVTQEHFTSALQCCNPSSLRETVVEVPNVKWDDIGGLEDVKRNLQEMILYPIDHPEKYEKFGMSPSRGVLFYGPPGCGKTLLAKAVASECSANFVSIKGPELLTMWFGESEANVREVFDKARAASPCVLFFDELDSIGTQRGNSLGDAGGAGDRVMNQMLTEIDGVGPMKNLFFIGATNRPELLDEALLRPGRLDQLIYIPLPDLPARISILQATLRKAPVAKNIPIPFLAQKTAGFSGADLAELCQRAAKAAIRDAIAAEELAQVNAGSDGMDAEEEEKADIVYEITRKHFEEGLSGARRSVSQTDLTKYDNFRMKFDPLYKNQAAGGDGQVLIDWPDDTNDVSGGIAGDDADDDLYS

SEQ ID NO: 42 - protein, 460 aa, Neospora caninum
MGQSVVFVMLLSVIFTAGAKTYGEASQPSASARSLQGALDTWCQEVFKKLCDDGYSKMCIPANQVVARQGLGRKDQQKLVWRCYDSAAFLAEGDENNVLSCVDDCGVSIPCPGGVDRDNSTHATRHDELSQLIKEGVVRYCSGFQAAANSYCNKRYPGTVARKSKGFGHKEPVKWRCYKPESLLFSVFSECVSNCGTTWSCPGGRLGTATNLDKKHFTDESGILQALTSVPKACPVGLVCLPRDQNPPACLDDNGNVPEEEGGQPVQPRDTKLPVDDSEPTDESETTPGGGDDQPSPKEDGDTDSPDEGDQSGGSEWYKQIPEIRVIGDSLQAMLHAGQQLMVTYSSPQLHVSVGSCHKLTVNFSDYYLSFDTTSKSGSDEVELDDAAGSGELTIGLGSSGRVTVVFQYATNGGGNRYVAYTVGDSGCKTIEAVLLHGLNPGAKLVRNTIGDNSPGESEL

SEQ ID NO: 43 - protein, 319 aa, Neospora caninum
MFPRAVRRAVSVGVFAAPALVAFFDCGTMASEKSPLLVNQVVTCDNEEKSSVAVLLSPKLNHITLKCPDNSTAVPAALGYPTNRTVCPAESGGQTCTGKEIPLESLLPGANDSWWSGVDIKTGVKLTIPEASFPTTSKSFDVGCVSSDASKSCMVTVTVPPRASSLVNGVAMCSYGANETLGPITLSEGGSSTMTLVCGTDGKPVPPDPKQVCSGTTVKDCKAKPFTDVFPKFSADWWQGKPDTKDGAKLTIKKGAFPPKEEKFTLGCKSVSSPEVYCTVQVEAERASAGIKSSAENVGRVSLFAVTIGLVGSIAAGVA

SEQ ID NO: 44 - protein, 575 aa, Neospora caninum
MLARASARVAKCGPGNLFQVRHASSKEIRFGCDARNQMLAGCNRLADAVGVTLGPKGRNVVIEQPYGSPKITKDGVTVAKSIELGNKMMNLGAQLVKQVASTTNDIAGDGTTTATLLARAIFREGCKAVDAGMNPMDLLRGINLAVDRVLAHLNSVTKNVTTSEEIFNVATISANGDKVIGKLIADAMEKVGRDGTITVSEGKTLTHELELVEGLKFDRGYISPYFITNSKEQKVELEKPFVLLYDKRISSVKSILPVLEFIVQNQGSLLIIAEDVDSEALATMVVNKLRLGLKICAVKAPGFGDHRKAMLHDIAVMTGGQVVTEETGGSLEDAHQMPQMLGRAKSVTVTKDTTLVIEGGGEKATIEERCDQIRVSMEQTHSDYEKEKLQERLARMTGGVAVIKVGGASEVEVGEAKDRIQDALCATKAAVEEGIVPGGGTALLYASETLKTIETTNYDQKVGVGIVRNACKQPCKTIADNAGHEGAVVVGNLLREADPKKGFNAQTGEYVDMMAAGIIDPTKVVKTALSDAASVASLMTTTEAAVVEAKEEKNEEPMGGGMPMGGMGGGMGGMY

SEQ ID NO: 45 - protein, 362 aa, Neospora caninum
MRGGASALVQALTVSGAVWMSPAEALTVQKSSHLAQLENSQHVEGVAESLALSPSFLASGISSEVSYTLATDDGTLICAISSEGQPCRNRQLHTNHGYITGASCPNGLCCSKTMCGAGGCGEFCSSSWVFCSTGLIYHADKSYGGDCSCEKQQHQCHKDAECVEDLNAGGSVRCRCKDGFMGDGKTCKPDPCQSRGNEKCGSNGSCIVVDANRYTCACGEGEVLEPTLEGGYSCKKTGCNAYSEYCNPGRCIDDASQPSRYTCECPQDSWRTTEGKNPMCYPTCEEMGGKDKCGPGSCRAIGKDKYACDCPAGYSRSMTSQSEEKCVQGAEASLAERCEKELGISLSASNAKCDCSKCGTAR

SEQ ID NO: 46 - protein, 549 aa, Neospora caninum
MKASSPKKLATWLVLLACLVWRSAAFQLSPPNSDANDLEVGDPGAAPENVAGEPRIGENSDFPEPRDEGVTDLRGGEGVAPRTPSTTRTHTRGGVVSRWFRRLRRGRDLTDGEESADESLPTPRASLRKRLGQHWRRVRAFFKGMTPPWLSGLPRRIRTWWSRQPDPSFHGVEPGSWFIRQILQDEQETIDYVRREMFQRHTLQVRAVSAALWRGDAATTVVSLLNQGARTLKVVEPLGRSDRSVVYRVQDVETNEPLALKVFTLPSEASRLELERLRDQEFAYQKLIAQSPEQAGDVCRLLLSYDAVAVQGQPPFGELSPGQSIYSVRNYFLVMPAAVMNLEIFHKAMDINVTFLPAAREEYVCKQILVELIRVAANLQARGLVHGRITSQHTLFMPDGRLMLGGTTALRRAGTYGPVSMVPATHAPPEFFSKKNRATAKYTHGLDAWQVGLVAFRIWCRYLPFGLATPGFNSAWTRPSMGVPGPTTIDFGHCVPMSEAVQRLIIGFLQLQSRKRLLPMSAIQTPEFRQLQLEISSRLSQAQGPAAAT

SEQ ID NO: 47 - protein, 294 aa, Neospora caninum
MPAQDEQQQQLPREAAATTEPSCRVYVGNLSWKVRWQHLKDHMKQAGEVLRADVFEDFQGRSKGCGIVEYTNVEDAQKAIKELTDTELFDRLIFVREDREDGQKFSGGRGGGYGSRGGYGGRGGGPMWASGYYGGGMYRGRGGGGYYGGYGGRFNGPPPYNMYGDMGYYGGPRAFRGRGGMRGGMRGGFGAYGGGFRGGRGGYAGGAGGHGDGSGRQVFVSNLPWRTSWQDLKDLFRECGDVVRADVMTMPDGRSKGVGTVLFSTPEGAQRAVELFNEYMLDGRPISVRIDRVA

SEQ ID NO: 48 - protein, 1335 aa, Neospora caninum
MLRAASFSGNDAGAFHVPHVTGGRALPLSLSKDEYLTQHNFFPPAHDEERDAVSSQRRDVRRGVDVQLHKHNGASAINPHGDEADVPLEQLMNDLGVGEGDVEHMAPSWHETSHRRSAVDLTMMNAFGFSELDATKSSASLNESVQSPTTKLHPSNLKSREQRVMDLLEQLETLTRQTPVEGEDDQFVDFSFEPESVTANDFSTSSSTESDNDASQLFGGLHSKPTASLFHGTEAGISMTDVTGHNASPAPAEEEQTAGQGDGGKFSRTQLMEPSGATEANESDSPHDVSEVAETPAEAGTDDPTGNNPPSPESDSGNTATQEAFTSTDASEKGADSESNSPDPTAGQSAGDTTPGTGEKGTDSQTVHDGQVHNLTTDSQDILPENHQGVNGAFTEPTAEDTTEAETNTQMPKHEKDGVVRQRDRMDAHSSAESISSKAPADFSDMMFARLREASRGMASVLHIVEHGRLLDDDSLVTIAYHFPFETRESRRIAFIIVALPPGYTARTEGPLCESVDPDMPPLSCEVRLAHLPQISLHEATEDQNVFIQVSSADKNRSLPLGMHHFAVAVHTPRLPIAVNTPANWWFVTFRFTGGHAVTKHFENRVLIAREKCAWGGWRQETPCSATCGEGVEVWSRTLFGGESEEACGGALLKKKCFRASCSVSCQLGPWETIVDCTKSCDADNRRGYQVSIRKVLMDKEGWGVDCKRLYPWNPEAHEGWSEKLGAVVRLSVCDTKFRQACEPELGCRVEKVNTRTLSVSYPWGSCPFPCGGLGKITSIVQVANGIPRWLGEKDFPESFQVPCRADKEPLVKRVPCNTFDCEDCSVYLERVKDTTAFRAWIFFLPSQDANTIKITAPRGINFDLKASSSAADAKSGGNQAPHSRVDGTETKTDLADNQGDVAGQSLHWKATHLLPQARKPTEEEIQASATEGQKTEKGQVAGSQQKSMSKNDAETHGRNQEDIRKLYEGNACSRLPTSFGYISSCGVSPSTKYEGAQEATMHLSGFIAPQVDTAFDRHIYPHLQSENAKHRLKEGSAEENRRPEWMAVPVTLEQAAEMENPGNFYMWLSSTSTPRDPEVFKCHLKTKLAVPVKCRYDYTVVDPKDCADCHLDSPKKIMTLRQFVPAKHGGSCSIPLEQRFKNPVAVYAKCSKGCSHVQHDVNSFPGSTEETSGTKEGTRATKTEAIPLSSRLKSVSRGSLKRILDRAANRQLTEGGTHDATHDPSLVHRIDINKIPDFEDVMKMAAARSDEEIGERHVGLEAKGGSPEHTEEAVGGPSAAGSPTTAIPVRPGEARSGNSETGDVVKDPDGSSRTGSSHEAPVVEEGTEKGETIS

SEQ ID NO: 49 - protein, 576 aa, Neospora caninum
MARKAKRLILADECRNQLLEGIEAVAGAVRVTLGPRGRNVLLEREYGPPMIVNDGVTIARNIELKSRAHNAGAKLVQEVASTSDEWAGDGTSSTTILTAEIARQGVDHVNKGHNPIPLQRGIQRAAKVMMEEVKRLAKPVEGMNDLLNIATVATSGNVAMGQVIAKSFDKLGRHAAIVLEDNPALEDTLEFTEGYTFERGFSSPYFLVGEDRDIIEWQNPSILVCDYKIETAQSILPILEHFVRTKAPLVLIAEDFGPEVLQTCIINRMRQLLKVVTIRAPSFGERRKEYLRDIAVATNAQLISRDLGLPLEEATPANVGNAASIVVRKDRTSILTRPEYQPSIKDRVAQLQKELEVSTSKFDREKLGERIAALSGGIARIMIGASTETEQKEKRLRYEDSINAVRAALETGYVPGGGVTYLALSTDEFYSKIVAEIEEAAKTEMTCDGDEPVGAAAEVVDEMEGEIELQKAGAKIVVDSMKSITKQIADNAGVNGDKVVRAILTSGKPFGFGWNAKTNKFGDMISQGVIDPAKVIISAIEHSTSVAGLVLTTEGMMVEEEEPEKNLRDVPDLPMA

SEQ ID NO: 50 - protein, 626 aa, Neospora caninum
MGVPIWAGCLLVLGVSLILPLGGCADEPATLRGVSAETEKHISAGKARLQDLRDAERRCHDAWQAIVVIDGGSSATRTNVFLAKTRSCPRGGRHIDPDSIRLLGAGKRFAGLRGVLESWLDAYAGEDWESRSVDSKRLFQHVPEMEDSARGLMQLLEDDAVRILDEKLTEEQKVQVQAMGVPVLLCSTAGVRDFHDWYREALFVILRFLINHPKPGHGYKFFTNPEWTRPITGAEEGLYAFLALNHLSGRLGEDPARCYVDEYGMKQCRNDLVGVVEVGGASTQIVFPLQDGTALPSSIRAVNLQHERFLPSRFPSADVISVSFMQLGVASSSGLFFKELCSNAEFRHQGICYNPCIFRGFRQACSAGDVEILPDGTIVVDEDVRKNKLKPVATSCSANNPEISFKAMNEMQCRENKIDPTKSLAERLRIDDCFQIVGTGDFDTCQAQVEELLVSPRFPLPANIEAASSGFESVGQVFKFASTASPMVITGGAMYASISTMQGFGLLPKDFQGDLEQLIAASRTYCSSPVVNSGDGLVIQLPNAEQKLTSMNYDLCKTIALTVSLLQHMEAGEHKPSSISWQKTVVGPDGKPRADLGWHVGAILHRVLFTEEWGRTAYETGFTYNM

SEQ ID NO: 51 - protein, 993 aa, Neospora caninum
MEDSARGLMQLLEDDAVRILDEKLTEEQKVQVQAMGVPVLLCSTAGVRDFHDWYREALFVILRFLINHPKPGHGYKFFTNPEWTRPITGAEEGLYAFLALNHLSGRLGEDPARCYVDEYGMKQCRNDLVGVVEVGGASTQIVFPLQDGTALPSSIRAVNLQHERFLPSRFPSADVISVSFMQLGVASSSGLFFKELCSNAEFRHQGICYNPCIFRGFRQACSAGDVEILPDGTIVVDEDVRKNKLKPVATYCSANNPEISFKAMNEIQCRVNKIDPTKSLAERLRIDDCFQIVGTGDFDTCQAQVEELLVSPRFPLPANIEAASSGFESVGQVFKFASTASPMVITGGAMYASISTMQGLGLLPKDFQDDVPGISRLLEGLFPETASAGGCADEPATLRGVSAETEKHISAGKARLQDLRDAERRCHDAWQAIVVIDGGSSATRTNVFLAKTRSCPRGGRHIDPDSIRLLGAGKRFAGLRGVLESWLDAYAGEDWESRSVDSKRLFQHVPEMEDSARGLMQLLEDDAVRILDEKLTEEQKVQVQAMGVPVLLCSTAGVRDFHDWYREALFVILRFLINHPKPGHGYKFFTNPEWTRPITGAEEGLYAFLALNHLSGRLGEDPARCYVDEYGMKQCRNDLVGVVEVGGASTQIVFPLQDGTALPSSIRAVNLQHERFLPSRFPCADVISVSFMQLGVASSSGLFFKELCSNAEFRHQGICYNPCIFRGFRQACSAGDVEILPDGTIVVDEDVRKNKLKPVATSCSANNPEISFKAMNEMQCRENKIDPTKSLAERLRIDDCFQIVGTGDFDTCQAQVEELLVSPRFPLPANIEAASSGFESVGQVFKFASTASPMVITGGAMYASISTMQGLGLLPKDFPGDLEQLIAASRTYCSSPVVNSGDGLVIQLPNAEQKLTSMNYDLCKTIALTVSLIQHMEAGEHKPSSISWQKSVVGPDGKPRADLGWHVGAILHRVLFTEEWGRTAYETGFTYNM

SEQ ID NO: 52 - protein, 362 aa, Neospora caninum
MAYGLPISQEVAKELAENARKIASPGKGILAADESTGTIKKRFDSIGVENTEANRAFYRDLLFSTKGLGQYISGAILFEETLYQKSPSGVPMVDLLKAEGIIPGIKVDKGLETIPLTDDEKATMGLDGLSERCKKYYEAGARFAKWRAVLSIDPAKGKPSNLSIIEVAHGLARYAAICQANRLVPIVEPEILTDGSHDISVCAEVTERVLAAVFKALNDHHVLLEGALLKPNMVTQGSECPKQSSHEEVAFYTVRSLKRTVPPALPGVMFLSGGQSEEDASLNLNEMNKMGPHPFQLSFSYGRALQASCLKAWKGVSENKAKAQEVLLERARANSEAQLGKYGGGAGGAAAASSLFEKRYVY

SEQ ID NO: 53 - protein, 416 aa, Neospora caninum
MATARPLVSVYKTEDGTASGTSLMPSVFLSPLRPDLVRFVHTNLAKNRRQPYGVAPNAGYQTSAESWGTGRAVSRIPRVPGGGTHRAGQAAFGNMCRGGGMFAPNKTWRRWHRKVNVTQKRHAVASAIAATGLPALVMARGHRIDEVPELPLVVSEKVEKVTKTREAVKILETLGCGAELERVRASAKKLRAGKGKMRGRRTHIRRGPLVVYAEDNGVTRAFRNIPGVELCKVDSLNLLQLAPGGALGRFCLYTASAFKRLQLLFGRHTGSGTAQLKKGYHLPRALMANADLSRIINSEEIQRVVRPARKAPQKKRGQKKNLLKNHAVMCRVNPAARNLKILARLSQTEGTKQRELVLRKKKANVAEHKKHRKSARLFAAEIRQAFSDKMASELEAAARRKAEEAGAVLEASAEEE

SEQ ID NO: 54 - protein, 266 aa, Neospora caninum
MAEEIKNLRDEYVYKAKLAEQAERYDEMAEAMKNLVENCLDEQQPKDELSVEERNLLSVAYKNAVGARRASWRIISSVEQKELSKQHMQNKALAAEYRQKVEEELNKICHDILQLLTDKLIPKTSDSESKVFYYKMKGDYYRYISEFSGEEGKKQAADQAQESYQKATETAEAELPSTHPIRLGLALNYSVFFYEILNLPQQACEMAKRAFDDAITEFDNVSEDSYKDSTLIMQLLRDNLTLWTSDLQADQQQQEGGEKPAEQADQ

SEQ ID NO: 55 - protein, 1059 aa, Neospora caninum
MQSFQKPENALKRANELLSVGQQDAALKILHGAIGHRRFRSQGWDSVQETIMIRHVQLCVDENKLRLARDGLHQYRIISQHANIQSLGKVIAELRSRAEQKLTQAKEAAGSPGPKGPDAPALVPATGLGDLDLIADSPEDLLLSTLQIEVRSAEARGIHQALRSVWDVYKMVLDLLRTTPKLERVYHETARKAFLFCKDNQRPQEFKRLCDVLRSHFALILKNRHKEDYESLMRPDLHLETRMQQLVVASDLELWRECFATAEDLYSLGLHDYFFKALRTGQDLFHNSREKLMRWLAIYYEKLSRVTWVAENYLFHALAWIKLLLHVKGFKKNASQEDLQAMASVAVLAVLSIPISGAEKKPGDDAVTMGEGMNYGSLEQQKKLTMLLGHSTLPTREGLKAVLFTKDLVSLADENCQQLLSLIESEFTPLKLCSLCQPLLDAVSENPLLEPYVYPLKRVIFHKLIFQLSRVYATLSIKHFTTHICTTSFLPWSQAEKLFVALVQQQQSAASGSFLGTGSSGPGAAANASGGGLSIRLDYASSAILFETPDAAAANTLRHQLCNLAKQIDKAVHMICPGQSVEERMDRRRFLQELPARLEAETKRMAERTRATHSRRLEKQEEQQKMEEERRRKEAEQRRVEEKQERERREEATRRREERRMQQEKIKQRSETAAQMLEEIKKLGGKASSNILIKGKQLGDINIDDVLQGNVDYDDLEKAQMMQLNQERIARLRQRRQNFRRVCHFIRACREEELPLLIKWQEQQLARDTQILLDMQNRHEEEHKAAFEAALEEKQIFEVVKGDKEDWVTEKLADRQKEFEKQAQEQRERLLSVLRQAKIQRARARKEEHLKKLKIEVERKRMEEEQKKYLEQLEKKRQEEEAKAKRLAEQAEKQRQRELEIEEKQRQLDLEATAAMRNGPSGPRAAAPASGSPSGKADRPGSPVAPAEASSADSWRRSERLDGAAARRRAPNAPSAGTGRGDQDEGFERWREGKLSSAGSPGNAAEEEKARPRLRIAAAALSEHLTSDKEVRAEAQNGDVPKAAEDDEGFTTVSRSRRK

SEQ ID NO: 56 - protein, 975 aa, Neospora caninum
MQSKFWAAGSDDSEESGFSSSDSEGEQEQVQLGETTRRPVVASRWAAAETSSSDDEGGRVVKSLKDRRWTAMRETIRQMKNHMKIADFSELYKDYEGLVRCLQKSQQIVEHEGLPSFFVRIIVELEQFLEEKHRDKEAFKKLSKAKATAFNTLRAKVRKTNEQWQEKVDACKADPSQFASSESDDDDGFDSDDSSDLSDISESSESEDSEDEKPKRKAKDDDSEDSDEGSEWSDSEASSLSSGEETDKHKAAMAKWGLRSDGEKSRKQKEKKKTKRVSSKTKDDGVSTPRGEGAAAEFSIKDMECLFDTSDLNADVIRKRVQMVVEKRGRRGVDRLEQTRILKRLAELAALVGPQSELEVLGHLISAEFDTTSGVFACLSSAIWLDVYHQLECVLGHLEEGVRKARESGKTEQASLYVLVPTILASTDAVDAALAAPDAQAVSSGILTSFVERLDDELMKSLQFTDVHSEEYKERLGQSVDMMAVLCRAWVHLTDCQSKPQAATLALRINEHMHYKHDTIAASMWDLVRKRVPADVAEHLPDENTKPSDFVEKLTNIVFESESSRERTRALLHLAYSRALHDDFYKARDLLHTPNMQELALQTDTQTQILYNRDLVQLGLCAFRNGRINEAHACLSEVCPKHKELLAQGLSNLKNVECTPEQERAEKRRLLPYHMHISMELIEGAHNICAMLIEVPHMAHDPYEHRKRPISKHFRRMLETYDKQAFLGPPENARETVMAATKALQRGDWKECCRFIFSLGIWEKLMNATEIQEMLKKKVKQEAMRTYIFTYLTLYDSFSISQLCGMFELPESTVHSIVSKMMINEEIHASWDESSQFILISRVERTRLQQLATTLAENVNNAVEQNELTLNMKNPKFALSHDRRFQMRGDGQGDRFGWGGREREGDGGPGGPGGRRFGRGGRGGFGPGRGAGRGGRGRGRGGLRAGAGRGWMGDRGEGGNWGAGGGDRWSARQKY

SEQ ID NO: 57 - protein, 704 aa, Neospora caninum
MQTDKNSKEGGSIQVEGGRCGESAVENDDACQYTPLTSPPVEVAEEAANEVEKVSSSLPVNEKYKETYEHMYWRSLHDADSFWREQATEILRWTSPFTKVFHGQMEDGNISWFLNGKLNVCDNCVDRWAEKFPNRVALICEGDDPEQSRTITYRKLLRKVCQFANMLKRLGVRKGDVVSIYLPMGPEIVYSMLACARIGAVHSVIFAGFAASSLAERIHDAQSRILITADHGSRGGKTIYLKDIADEALEMCPAVRHLVVFRCKGEPLKKWVEGRDIWGDDLVSQMQPYCPLEVMDSEDPLFILYTSGSTGKPKGLCHSTAGYLLYAALTHKFVFDYHPGDVYACVADCGWITGHSYVVYGPLCNGATTLLFQSIPNYPDPGRYWQMIEKWKVTQFYTAPTALRALMRFGDSWPQKYELSSLRVLGSVGEPINPEAWRWYASVIGQNRCSIVDTYWQTETGGHVLTPIPGATVTKPGSATLPFFGIDPVVLDPVTGKEKTGNNVCGVLCLRRPWPGMARTVHGAHLRMMSTYYWPYRGYFFTGDGVFRDADGYYWITGRVDDTLNVSGHRLTTAEIEHALVQHEDVAEAAVVGVPHEVKGSGIFCFTVLKENVPVRPQLEDELKRVVRKYIGPIATPDYILIAQDLPKTKSGKILRRILRKIAALETDDFGDTSTLVNPHCLDTLIEAAKRSREGTLAVKAQSA

SEQ ID NO: 58 - protein, 251 aa, Neospora caninum
MGNACKKNAAKTPTRKEAEDLAEKERQEREAKEKAEAEEKARREAERKAAEQAEAERRENEAREREEQARKEAEAEAARKQAAEAEAAEAQRRQNEAQEAKEAEEAKRKEEERLAAERAAAEEAERQAREEEERRQAEAAAAAERERQMQEALKQEEMSPREKYDKLASPEDSASETTMATQPQKVAEHSSAAATDRSVMGHTITPCDMGAIDETAKYVSKRCGCDLGDQHDENACPICRQIDLSDAPLLN

SEQ ID NO: 59 - protein, 277 aa, Neospora caninum
MAASTKKGSASAKGSSGGKKKLPAAPLSSKSGKKVQKSPIFAKTPRNFRVGGNIQPRRDLSRFVKWPKYILLQRQRRVLMQRLKVPPAINQFTHTLDKNQTSQLMRLLAKYKPETRAEKKQRLLQEAERQSAGGAAGGKKPVMIKYGINHVTDLIEIKKAKLVVIAHDVTPVELVCFIPQLCRKKEVPYCIVKGKSRLGQLVHQKNCPVLAIDNVRKEDQAELEAQCEIYRAMFNDNSEVRRRWGGGINGIKSQHAQQKKEKLINIELKKKMGLQLA

SEQ ID NO: 60 - protein, 133 aa, Neospora caninum
MPVSEQNMREAFIVFDRDGDGELTHQEAALAMRSCGVPVVDQELDLPGKVNYAVFKDYLMKRIAVSDPLAELIKHFERVDRKKDGTIRTEELGQVMKALCSSMTEDEIENLMRRADPNKSGSIKYAEFVHQCF

SEQ ID NO: 61 - protein, 387 aa, Neospora caninum
MIFRQGRACVAALGCLVAAVHVFGNLSLDCVRATSVGSVGKNSDDKGKVASTKIDLDPKDLGQFGYVPPGDGRDPAGDEVQECKYPTDGEGVGRLDVLVPGSLVVAVRCPDGSSSDFTPANHTLAYTVNSDGSCDTTTAVDLDTLISHAVLDERKEKGDPLLGSMRFFAGGLPLDSEKKACFVCKGKTGSNKGKSCEVIVTVPKASLPTGGCGLYTLVVIPQRAVDFSVTRIRLLEVGYSAGLPISRRNVLCCVRPPDSLVCNPNGDPPENMLTFQGDGSEKTATVHCPPGYSNLDSPDEDGYVMTGPQCMTKAKLEDVLGSGSTIKTVELKSPPRGVSKSYQVTATSSFAEPRILCMRCVPGDGENKPAKTEDCELVVFLPVVEGK

SEQ ID NO: 62 - protein, 1408 aa, Neospora caninum
MKQGTIRSRIGLTGVFLLLAAWSVASPIDGSRRQILLDRLPILARLRRGSSLIESGTSGPDPSQRLTRTDKIRKPRSDRRSYRYVELPNELRALLVSDPECDEAAASMRVGVGSTSDPPDIPGLAHFTEHMLFQGSKRFPGTHDFFDFVHDHGGYTNAFTSKFSTVFSFSIGPQFLEPGLDRLADIFSAPLLKDENLLKEVNAVHSEYIVDLTDDNHRKHHLIRQTASGGPLSNFTVGNLESLVERTKQQGIDPVKAMRQFHNRWYSSNLMTLAVVGRESLDILESHVRQHFSNVPNGRVTAPVFEECSETFVPLAPNELGTQVNVSLTEEGRSKDSVYKIGLRLFTFLRNLGAARPERWRVTEMAKIRQLGFTFADMPDPYALTVRAVEGLYYYTPEEVMAGDQLIYRFDPTLVQQYLQKFLVPDNVRLFIFDKKLAAGASREEYWFKIKHMVEPILEPVLKTWKDISKSPLDMVQKIMEMGRMALPAPNRYLPNNVAVLHPPVSAESRRETGTFPEPLVFPEDHACSNKCTVFHKQDTTFGSPKAVVELQMYYTGNHPDDVRERILTTLYVLSIKLALRERFSDAHRGGLSLGLSSGVTLGSPTLPTVKRQKVLTLYAAGFSDKLDYFFRAVAKNLAAAESASDENRTSPSPTALGVTVSHGLRQAVHSKITLPSSVLSSVHSSRLDSTAVRFPGGGGLARRTLLHSQITTLQQKPASVALTVMRSPITNVGIPVSRSRQGGDTGSAAAGGSFTGEKPLLEKRFVKLALDSLRTQLRVTTFNRSPLRQANDAVLELVMHPYIPVHKVYAAFLEMEKEYRTLDTIFEEVADWGKKIWNEAAIEGLVQGNISSESAAQLVGDVISLLPLKNIVSADSIAKPTISPLSSLGEASSAVSDSSPQRLSVVSDTPTSNDTAYVPSSENQTPASTGHAPSVVFRGPPLAERILKALPPFGKVRAIRRRWEVRGANAHSLQYRPLRFSSAWLNPNPTEERRILLRRVLRRRLAAMRQKAQTDTQQNPFVVFAFRRPPTVARRLRIAQGRSFLQSQGEVSKGSEDPAAGEAGDGPCAEGACAQRLCRGSECQQTPKRASESPCTGEACRGSPCTSLECQRSPSSKAEQPCTDNDCSGPCRGPGCSSAAASQLSDCTEAECGRTCPGCKHLEEKSLHLRSKRKNMNPNDKKNQAYLVIEVRQMEDRRKLVSPVEGRDTLKNIRDRAILHMISQWMSQRFFNRLRTEQQLGYLTAMRYSRLEDKYYYGFFITSTYDPAQVADRIVQFIYAERSKALSQEEFATLQRAAIDVWKQKPKNIFEEFSKNRRQVILGDRLFDINERMVAELERVTPEEIQSFKERTMFNAPWLLMEVYSQREEPQKLPQASITSGEGSANPWLDVNPELLSNINVPESEDS

SEQ ID NO: 63 - protein, 263 aa, Neospora caninum
MARGPRKHLKRVAAPHHWMLDKLTGHYAPRPSPGPHKLRESVPLVVLLRNRLRYALTYREVMMIVMQRLIKVDNKVRTDQCYPAGFMDVISIEKTKEHFRMLFDTKGRFVPHPIRDEEASYKLCRVKKVVVGPKGVPALITHDGRTMRYPHPSIKAHDCVRLDLNTGKIVDTLKFEAGNLAMVTGGHNVGRVGVVVHRERHLGGFDIIHLRDAKGNEFATRISNVFIIGKGEKAWISLPKEKGIRLSIMENRAVQLKKQQLNN

SEQ ID NO: 64 - protein, 513 aa, Neospora caninum
MVPNGDRLLLLWTGFLFRLAACHPQSGLAYHGVDRLPPRDIGRFLDSANHATLNSHVLGEGTGSASPSYLQLHAYNPALDDGLEVPQRSLESALYQPTPIPVATTATDRRARRSLRRLAAGIPNEERQSRASSTFRALLSSSIIAELEFSLDILRVLVDSARGSPVVYDLERTLGTGTSSIVVQAVQSSFTPLPSHREMLPRFLSRLFSHRSTDTRSRVALRFPVVNLRKKQVEYPHLTEGELLDLLLRKQLERELHAVALVSAAARQVEGIDGKWGFVLPMRLGRVATQRTTLARDPDGNAMLNFASEMPTMLCDLLCIIYKRNRGPSLDAYVLKRVLQLAVNLETLSLVHLDITPQNVLIGQDGQLYLGDFQSVVRSDTTVPCRDIPMSAYTDPRLAYCAVVTPDDHVVVDKSHDAWMVGMLLLQWLCGDVFFDLRTTVGDPGQRMRVLAQMHQDFRETHTYAAPVTAFQDWERCRGRIKGAHKRLVQQLLDLNPFTRGTATLLFASYFAP

SEQ ID NO: 65 - protein, 842 aa, Neospora caninum
MAVIGIDLGSLNSVMATVQRGTVSVVTTELSDRVTPSLVGFTEDRRLMGDHALAQVKSNAKNTCRYFKNILGEVFEPTSSHLKKEMDLSLNNMVSLSPNNVMGYRVQYRGKEAQFSAERVAAAFLTKLRQVAEGSLQKPVSEVVIACPPWFRDANRSALLDAAQIAGLKCLRIISDMAATCLDYGMYRRHHFAADRPHIVAFVGVGHSSTSACIAAFWADRLRILAEVSDCELGGRDMDYEIMNYFASAFEKKTKMNPLTNLKARLKLEDQANKAKKILSANSETSFHVECLMEDEDCSGLLTRDVFEELCSKSLVPRMETLLQSVIAKSGLKKEDLTSVEIVGGGTRIPWVQRCISNSFGLELSRTLAADETVARGCALQAAMASASFKVKEYGFGERTLYPICLTWTDGDSPVAVQPLSSSGYPLQETDAGVETLQHQTPSGEPCILIPAGSDTNTIRKITFLRNGPFTLKAQYADLPAGAPWAQLDACHVSLTPAAEPQEIQIFVHLNFFGLLRFARVCVKQRREEVVAETPEGAAAPAEDAAQGTDEAAPAEAPKAEVRAVVKTVKIDVPYQVQEAPSRPTTLQLREFREDELNMDNEDRLTREKMDRLNELESYLYTLRDDIGGKMRDFATAEERSRIEAQLETTQQWVDDALMDISAVAKSAVVAKLQELQEVGGKVSHRFEEYSGRHEAEQLLLAAVSESRLAAQSHDEAYAHIPVEEKRKVIDMANETEAWLSDMSLIRRVSFSPLQMAKQSGLALHADPIVTVLDMHRKREALLHFSQKVFSAPRPKPAAPAAPEPAGAQEDVNMNAEGEQAVPNAENAEAPGEAQPHQQPAA

SEQ ID NO: 66 - protein, 183 aa, Neospora caninum
MKADPTLQQKIFQYQVVGRKQPTEAEPTPSLFRMRLFARNKVLAVSKFWYLLKKMKKVKKSTGEILAVNEIREKRATFVKNFGVWLRYDSRTGTHNMYKEVRDISQNGAVSQLYAEMAGRHRALPSNIQIIRVAEIKASQCRRPHMQQMFDSKLKLPAIRRIFPTPKDKKSVFCARKPTLFLQ

SEQ ID NO: 67 - protein, 506 aa, Neospora caninum
MGQQESSLGAASSEPRLRGNAGAAGGAGDKLHATPGMFVQHSTAIFSDRYKGQRVLGKGSFGEVILCKDKITGQECAVKVISKRQVKQKTDKESLLREVQLLKQLDHPNIMKLYEFFEDKGYYYLVGEVYTGGELFDEIISRKRFSEVDAARIIRQVLSGITYMHKNKIVHRDLKPENLLLESKSKDANIRIIDFGLSTHFEASKKMKDKIGTAYYIAPEVLHGTYDEKCDVWSTGVILYILLSGCPPFNGANEYDILKKVEKGKYTFELPQWKKVSESAKDLIRKMLTYVPSMRISARDALDHEWIQTYTKEQISVDVPSLDNAILNIRQFQGTQKLAQAALLYMGSKLTSQDETKELTAIFHKMDKNGDGQLDRAELIEGYKELMKMKGQDASMLDASAVEHEVDQVLDAVDFDKNGYIEYSEFVTVAMDRKTLLSRERLERAFRMFDSDNSGKISSSELATIFGVSDVDSETWKNVLAEVDKNNDGEVDFDEFQQMLLKLCGN

SEQ ID NO: 68 - protein, 598 aa, Neospora caninum
MVTESNMANGVAPSQGGLALIKRMSPYWDSHMSIPVMDWMLSNEMITPEERQQLGQNLLGQAATTPEGRAAVEAEIREVEAKLVNFNNAIEAYKKEQQKRIGGYPDRKTLVDLSEWWMTNSGQTPAPPALELGVDALVPRLAKLYYDIGDYKKSLQQLQYMLTTLYELLAEGTNTQTRMACYWGVCACIILLHHQQNENRSATPEETEKKEAEQEEELLQTLDNGEDEDDGARAALAEAAKKAAVETHAAAQCILKLGDILDQVAAASNKKDYQGNQPLPAGLTMSREQQLLNRSWLLHWAVWPLFRYYFLMVHTKQFIPRNQAWSLMVEWVLHEGNLSCVTVVCPHLLRYYAVYAILNRKRKDHFQAVITAIGQGKNRYTDPFTSLLEALFLDFNFDEAQLHIARIGEECDSDFFLQPLKGAINEFARLLIFETYCRIHKCINVDMIAKKVNMSPEAAERWIVNLIRHARLEARIDSEKNRVQMSAAPPNLYQQVIDKTRNLCIRSNLILQNIARPAGFTGRDGDDAVTSRTNRQRGRGRQWVQGEGDGFYRGEGGGRGGRGGRGDRGHMGDGRRDPMAAVAASMASRRQDDTAFAA

SEQ ID NO: 69 - protein, 391 aa, Neospora caninum
MVKSLHKFLSKNVVEAMSLEDFVAELGVDHRAIQPPFFRKGEGASRAVGYFAEQQKPEVSEETRKTLEAVEPVLPAGQPLSFHTTYDRKGSYFKRGSLFHRDFFEFFIDGQPFDLRILPLPSGEEGEATLERYKKELENERSVRLQFDVGSAQRVVEAFHCHIPFQVLQFTSDRKVVSLGLDLKMPNIVLIYPGTRGTLGQLFPLIHQAAQNQKTAPAALAARLSVTVQAIKLVAVTSGRGILVSNISPENFFPSRDGILYFGGFSSKVAANKLYYETEGGALVEEPPNVTSRGRRFTAEDNAADLGRTLFGLWCGGSLPEDEPSGRADVDFSNCGTDLPDPVKKLIMGVSGSHGRAPLSASQVLDTPNYQELRRLEKEVSQSVAVRSVVG

SEQ ID NO: 70 - protein, 474 aa, Neospora caninum
MANAATEKASSAAGGKEPKEKLAPVPKPNDKEFKDRIDAETKAIDELKTQINELQQRITSVIGGRDEYNRKKQEMRARLDELQAQMDKYEAERKKLIEAIDSRQKEGWEMKQNVQDMKRKLGFSTTEEIDRRIAALEHSMMTSTLTLKEEKKLLDQIKQLKHNKPLVGKFAGLEAGASSFEETSVYPLRAMLDEARTKLLELRALKREEQEKYFALVKQRQEATAPGRELIEERDRLSKQMSEHMMKRREIQDEYKKENWKYQAFLAQQRQERNEKMREERARRQVEQERANLERQLEMVDEEPVDGELVLLTQTIAYVQKIIDEHQTQDGSPIHEEKKTPEAPKGDGVALLPKNQREEEYFFAPKSAKKKNESSKKSKPKSIKHDLGTLLYFEQCGVAAPVCEADLEPCMKVLEEKLAAAKELQATKAARVEARRQELQKELDAIDARIAGRTEKREAGSEGEDGAAEAEEEE

SEQ ID NO: 71 - protein, 865 aa, Neospora caninum
MRASHILLACSVLIVLLCMDARGLRVRKDGDVLSPKTFQPDGGENTTDPSDIIEEVRKVEKQVEAEAAEIIKAREEHRGFNTLDDGVAPETEGGHGLHASETTPVAELEPQDPDRSLKYPVRLLIVDKPAGDEEETRPSFVQTALHSELAQRVVKELNGHVDVLDESGVVLVDLPANTTDKQLKEVIETAKAQGAIVEPDHMVSAVHTSSRESNDPLLHELWALDPLNMRAAWDILTTAELGGDRRPLVCVVDTGIDYEHPDLRENMEVNQVELHGKPGIDDDNNGEIDDIYGANMVSDSTDPADDHSHGTHVAGTIGARGDNGVGIAGIAWAPRLIACKFLNARGRGFDSDALRCINYCAKRGADIMNHSWSGSDASEALRQAIEQTAQQGIIHIAAAGNSGRDVDVTPNYPAALSTAVEGLITVGNMKMEKQRDGSKHFSLAESSNYGTKSVQIALPGTDIYSTIPVQERPDDPYGWKTGTSMAAPALSGIVALMLAANPGLSATQIRSILMQSVNRTPELSTRVTWGAMPDAKRCLDAALVTPPEGRRPGNPPSHPPPEASPPESSPPDRQHPHPHPPRPNPPEASPPEPSPPNWQHPHPHPPRPNPPEASPPEPSPPNWQHPHPHPPRPNPPGASPPESSPPNWQHPHPHPPRPNPPEASPPQSSPPEPQRPFSQWPHTPHFFHYHPYPGYNLPYFTYHQSPLPYGPYGRDPCPCASHPYPADDSPLGSYAPDPSPPQSYPPEPSPSKPSPPEGSSPRVPSPHRHPSRSRLPSAVEPSPPPASPQPSPHPSPPDTSPTKPSTPPPSPSQDPEGRREPSEEDDHKSLSDKSTSHSSEGHAGATPLARVGVLAVFLTVVGLIV

SEQ ID NO: 72 - protein, 495 aa, Neospora caninum
MSELTAGSDMFSAIPAGVQQVIRNVVFWGATDETAQKWRLRVLGVGAVAVAGAASWVYLIYPFLQHMKVRNLPQPGTSTWLNGDKKELEKHVKGGEKRRYFSRLRQTVGPNCFIRLPLQFSLASLTKNPFGLLFVTSDWNVIQELTTQSGSLDLVALNDTRAVDALQLTRLAMFDLWLNLLTGRQGHHALTASGHLALTPNRIETGALPYSTVEAIMTMTRFHKENYELLFLPTDSSAVTSTAAHKALVQQYKAVVNAAPVILTQMLDEKNQQALLPRILAAEDSVTRRGLAADEIRDSAALLFLASENTALPIVWALYELAKDQALQQRIHTATRVEDLTVIDSTDQLISRLGEVLNLFLEALRFYALPILSRSASSPIQLKSADLTIPAGTVVLVDNYSLTRDETLWGQDANVFNPDRFSGKIWQQAPWLPFGFGSRKCIGERVAVTHAVLFLAVVVRYFALELDTNSMPPEPVERQFLTPDKPVMLRFRPRV

SEQ ID NO: 73 - protein, 890 aa, Neospora caninum
MAIMKSKFTGSGLLMLLTLAFGTTVQCNEPPSHPQLSQSTDTSATPTIYRSELETTLKVPGGAASQKPLASTGNVSISAESTGTGSETPTSQAEGTSESLQERESQARPTPAPRRSEAQAQGQSPTTAPQSTVSTNTGESGNDGNDNETKGLYPSLDELKANGLYPSLDELKAKGLYPSLDELKENPNVTTPIRPSKGLYPSLDELKENPNVTTPIRPSKGLYPPLDEYRHYQEITWFSIPVPMGVVDRRETRALKQQFTQFLQQLSANYPKLVQRVYEFLGWPSDKLPENEEQAQMFIDALNTSEALLGKAARWIFNAIPEMERAAIYTSFYQLFRNKLPSSFFEAAGRVNPEVREYWNAEMPITGTWETPSEADKESEAGGETANSRKGQAHLTAQVLQPLPVEGPTPRDRIPWMKIKSAISKAHGPVTRVPEWTPVTGACALGEGYTEIDVAKATTDVLFRLTFVILHQIKRKNSNNGKLEDDQALVALCSTAGAFVDAWQQQQQALAQEDPGTPKAHAVLIERLRHVDKYFMKTYDETTGESDHKQWKKNKTEVAKIGRVKAAGDVATRSFNAGTTKYPSRSLYGGIANTLETKFTDSEAVAKAVHDYARQHKMPEKLVGLCGALQISGHFKKCFSEAGRLSSVTFFHQHIDGASVLLRTLARDRPIGKHAVAQAICDPSVSAQYFESAFRLFSSAVTQEWEKENLFAQLASWTGKPVILAPSLEDQVPVPPAHAAYESVAVDDPDRIYRIRAGGRQSPPEVLYVGGLHPKVKPTEVHVQGPTVRDNSKRLVHDVHPSEPRGEKAPSGTATTTESSSEDASSASSKSSSAFVDVQAQGKNNYEPGETVDSHLASPRKNEENSASAMPKRSTHSQGTGRTRSVSAEL

SEQ ID NO: 74 - protein, 1981 aa, Neospora caninum
MDETQNSPASAAEAEPPSSEPSASAGLPAGDEGDKMEVDPEPAAQGQPEQPAPQPLAAGSSAPGAASSLEETAVEREVEETAVEREALLAQNAQLRRLLEEHAGELERLREETSPRRPETGSGEEKASPEDPGTAAASSKSLEEELLALRQKLRSAEDQILDLQSRNDRLVLEQQHLVESLTREKVERLSAERQSLAAAASASSAEGRQRLQQQRLEAAESAQTQLRGQLALARQEQQQQLEEAAEAARVAAKTKATLEAKLQEAQEEKELQRKKAEDLESLLRHRQRESALEHEKERQELLAAQEAVALKEELLVLKTQHVDKQEKCLKVLQESNDQLQRDNHRLATLVEEKDKELGQLKETIARLEQAAKASGSTGQTDQDRTDAASLHDTALPLPPRLSREEATGVLKQRFGDIQDGGALQTLISDKMTELVIELDAKTFECLAAKSRLLQRTEEAANWKAAALQLENGRKEHEARVAELEEKNEELSGRMQQLLLLHRREEDISHDLRVELRQKDDEAQRYLQRNDELLRQLAVAAWEVQRLSGGDSHAASREGKATAPFGSLFGLASASLQKALGVRASGRDPATGKAASEDEADVGLLSYMEVLEHNNALKLKLLQLTETEAEAKSLEERERESQLAQLQAELTTLQGDLKTVQTERKELVTAVQQQLKQREEMQEKIKELEARLAIASRALPEPSGSCDGKGGPQQAGAFAASERTQKDDRETDGDDGEASQDRLRLSKLVEQLQEVAAVLAVEQQQGRLQREELQQARQQLATQEATATFFKQECTRLQGSVEQVQLLQQQTAARVAAAEEKSRALEVSREELRGELLAERGEKKRLQGEVDEVRQKWRLAELGAQELQQQVERGIEKETDTKRQLQEERAALQVRVDFQQKQNLALCEQHQKDLEVLQEQLRQAAQVAQEREEKCNALQQRVENRTEEVHALQNKLRSMEQQAADVRGRLEEQKKLVAFLQRRASTSAFGAARPEEKEGEGAGAQPGLSPELRGPSAGGSPEECLKLQGQLTQQQAEMCRLREEIESCRTLKEHWEDVAKEQQKEQRLAAEKLAESQEACEAERKKLEEEKQKVEALTREKEDQQVEVGRLQAALEALERREEEQRAASQQAAEAAVAAVVDNLKAQTATLRGQFEEAEKKREEAERCYKRERESRAEDVRRADDVHKEVRVLREKKRKLQEEKEEKEEAWRRERLEAEEELSALRQQNKALLRDVERLKIDCKNLNEKIVKNTAATAAPASDSGSDALDSTATLLKVRLEEASVMRVTMEEELHAARLDIARKEVEIRVLKKQVEEGRAQRRAEEKRMEELEGELQTNQMNQTLLGKIPTLELDNERLRKELEAAHELQRKQQQELQQQRQQLQPLLLQTRQKEAALEAAETQRKSLAAEAEEWKQNYQKMIKKFQGVDKNKVEQMRGENERLQQQLQAIGAERASLTTSLKECQGRQAELESALQRQQQLSRQQAQQFQQLQEKAAREQSALQQQLARQSQASADAPRLLEQERRSNALLRQRVERQEALLKQAQAASNKSLSPQVAAAVGRVARVGVVAVATAGQALEATKAATLAAQEQQKMRSVLDAAAAQAQKEIAQLQQQRQQQDKALAMSEGRVRQLEAEKRQTEAERDSLLRQTAEQEHLLQQHAQATETQQREMERLAAELQLARAQLREIREDREREGEREQEREQEREQERDEEGEREERDGEREERDGEREERDGEREERDGEREEEVSAALLENQEEVEMGEGVQEVDGEEEGSAETSLGHDSRREEEDQDPHAHIEELERGGASETPPALTLGEDEAAREEDHAASGDMREDATLSASDGAEGVPGQTGREAGGQEEDGGALPLSQEHEERVEEGVPESPAEAVAAGSAEEGTEMEGEFHEALPHLPGVAEVEASHEGLEAEKDGESPFQGNAIPTDLHGAQDEGAETGETPEVEGEGGMREGLDEETGEKEEEMAQ

SEQ ID NO: 75 - protein, 818 aa, Neospora caninum
MVSSLSFAKNGDAGTMSNPSRKGLSGSVCIPVAPPTASPTFFLHQVKAALSSSAFPSPSTVLSSCCIQSKDARRGLFRSVARGLATVSCSGEDSSIRGTAHADSANTKDSGADAGQGEVHSFKAETRKLLHIVTHSLYTDKEVFVRELISNAADALEKLRFLQATQVSGTDSNQSIPLEIHLSTDAAAKTFTLQDTGVGMTKEELLEHLGTIAKSGSLEFLMKHQGEKNADIIGQFGVGFYSAFVVSDRVDVYTRAHEEGAKAYLWSSDGAGDFTVKELSEAEAEAAGLKRGTKIVCHLKKDCLEFSNIYHVKECATKFSSFVNFPIYVKEGEGKDTKITSQQALWLQASATEDEHRQFFRYLSNTSWGDPMYSIMFRTDAPLSIKAVFYIPEDAPSRLFQPANDVGVSLHSRRVLVKKSATDIIPKWLGFVKGVIDCDDIPLNVSRENMQNSLLIEKLSQILVRRILKFLDDQSKSNPEKYLEFYRKYAQHLKEGVLDDAHHGSKFKDSLLKLLRFQTSETPSGELVSLDKYLEMVKPEQQNIYFYCCPGRETAMASPYMEQFREWKRPVLLMMDDIDEFVAMNVQSFKDKKFVAIDAPEEDFEPLLEEDKEGRKEKKVDTPALVGDHRKELELFVQNTLGSRVSSVKFSDRLVKTPAVVTGFLSSTLRKMMKATLQGAPDAQLKMASLPVTLELNPHHQMITSLYHLQRTNSDVAKLLVEQLYDNACIAAGIMEDPRCMLERLNHLLEVTAQYAYHHTENAAAADVTSPDSDTTSTSATEDKRKQPESSAAQEVCTGVPEVEPKKAEAVGREGASA

SEQ ID NO: 76 - protein, 428 aa, Neospora caninum
MASLRLRAVLSALCCLALVASASVEGARIRIDPMTHDVALVTQQNWDGKVQKFRSHQVFAVLFYKDDCAECQNLLDGEFNTLAKKMKGMVGVLAVDCGESPKLCKDQNVASYPTILIFPPLPLPPYKFEGTPDYASLSKAVGPLIPSSVIVPKEMKDFEKAMATHIQVPKVLVFSDKPKASILLKALSTAFKDKLHLLLISAEKLPEVVKKYRVTKFPHIVVTRKDKKDEVYKGDFNFQVLFDWLNVFSETFVLGGGFSDHTPKAEPTPETQPWKFQVIPELTKRSNIDLCFKKSLKALCVIYLKQGRDLTPEETDMLESLKYQYDSGKGPDFRFMYMDVDTETGFRDLFAIDAYPSVVVFNPHLKTRFTKIDTDKPLSKEDIANLLNKISSGNARFRVVPSSKMPSFVDRKEETEEKKEKADKKDEL

SEQ ID NO: 77 - protein, 832 aa, Neospora caninum
MVNFSVEQMREIMGNPKNIRNMSVIAHVDHGKSTLTDSLVSKAGIISAKAAGDARFTDTRADEQERCITIKSTGISMYFEHDMEDGKGAQPYLINLIDSPGHVDFSSEVTAALRVTDGALVVVDTIEGVCVQTETVLRQALAERIRPVLHVNKVDRALLELQMDGEEIYQTFARTIENVNVIISTYNDELMGDVQVYPEKGTVSFGSGLHGWAFTVERFSKIYAKKFDVPKEKMMERLWGNNFYNAKEKKWTKSQSENTRRAFCQFIMDPICTLFTSIMNDEKEKYTKMLGSLGIELKGDDKDLTGKALLKRVMQLWLPAGDTLLEMVVRHLPSPFAAQKYRVENLYEGPMDDEAAQGIRNCDPNAPLMMYVSKMVPTSDKGRFYAFGRVFSGTVATGQKVRIQGPRYVPGEKTDLYLKSIQRTVIMMGKYVEHVQDVPCGNTCCLVGVDQYLLKSGTLTTLDTAHNIADMKYSVSPVVRVAVKPKDNKELPKLVEGLKKLSKSDPLVVCTTEESGEHIIAGCGELHVEICLKDLRDEYAQIDFTVSDPVVSYRETVSAPSHMTCLSKSPNKHNRLYMVAEPFPDGLADAIEAGQVNARDDPKERANVLAEKYDFDKNAALKIWCFGPETTGANMLIDTTQGVQYLSEIKEHCNSAFQWASKEGVLCEENMRGIRFNLTDVTMHADAIHRGAGQIMPTCRRVLYACQLASAPRLQEPMFLVDITCPQDAVGGIYSTLNTRRGHVFHEEQRSGTPLVEIKAYLPVAESFGFTTALRAATSGQAFPQCVFDHWSTLNGDPLEKGSKMEELVHNIRTRKNLKPEIPPFDNYYDKL

SEQ ID NO: 78 - protein, 436 aa, Neospora caninum
MASAPVAAAPAASSRSAGSVEKAVRSRPTLALLFPVFSLCVILGILSAPSSVDAQLKFVGLGNWGYGTTSQKTVADTLKKVAAAEHISFIASPGSNFAGGVSGMNDTKWQTEFENVYSDPNGALKMPFFTVLGVDDWSGNYTSEALRTELTYAATSEQIKEGKLAPSDASEAAAAAENTGYPKWTLPNWWYHYLMHFPANTGGAFINSGHKDMSVGMIFIDTWVLSSSFPFSNVTSRAWEDLEKTLELAPKILDYIIVVADRPVYSSGASKGDSMLQYYLQPLLKKANIDAYISGYDFSLEVISDDNISHVSCGAGAKAAGSAIVKHSGSLYYGSETGFCLFELTAEGLVTRLVSGTTGETLYTHKQPLKNRPERKSIDAFNFVSQLPEVRYYPVPEMGKMPGRDVFVRVVGTIGLCIATIFLSLSVASGVSRYMK

SEQ ID NO: 79 - protein, 192 aa, Neospora caninum
MATEAKLFGRWSYDDVNVSDLSLVDYIAVKDKACVFVPHTSGRYQKKRFRKAMCPIVERLVNSMMMHGRNNGKKTLCVRIVRHAFEIIHLMTDKNPIQVFVNAVENGGPREDSTRIGSAGVVRRQAVDVSPLRRVNQAIYLICTGARLAAFRNIKTISECLADEIMNCAKESSNAYAIKKKDEIERVAKANR

SEQ ID NO: 80 - protein, 338 aa, Neospora caninum
MQTMSSVAHRREHQTATRGAAEAALALAEKVAKDAMAAAYNEAFRKWTGISHPDFHTTDVENCRIVLSFDVAKRKKAMGGVTEILSVVVDNAKQQLTVKYLERPSIRNATDVRRASSWLKRKLAVDSKEEVVPVSETIEVPSACMADEYSRYFVVKRSKKQGTQRVFAAIVELAFHPGSFVVPRDIAKRSQLDLILRQLQHKQITEGLWEMMPGCMMFIRVQSQLRGAPRVAINPSRGTVEFRGEEVKGVGSKALPKECTWDDPNSVSVMTRHNRTVGSDMWDVLLFMTNAPSETRKEYELPKAAEVERREELTQLSSLDESVQDNDMKVGASPVLAN

SEQ ID NO: 81 - protein, 503 aa, Neospora caninum
MADVTEKPVEATAELAGEEDQAVPAEVPAEIQASAAEEEKPSNGEERLAKPTFVVRLRGLPWDVQEENVVAFFKPVVALENDNVLICIGFDKRTTGEAYVQLPDPGLREQAIKDLHGRLLGTRWIEVFRASEEEFQKADDRRKTVMAAISGNTDSLDASRRMNLNVVKLRGLPWSCSESEIVRFFKAEGGFEIHNDDVVLGVTGDGRLSGIAFVELPSPEVAEKAREVLHKKYMGRRFIEVYPATREDMQRAKRPVRGGFDGYYHGGFNSGPMRGPGRGGFRGGMGRGGYGGHGSPYGGGGYGGGGGYGGGGGGYGGGGGYGGGGGGYGGGGGYGGGYGGGNGGYGGGNGGYGGGNGGYGGYGAGGGGYGGYGGGNGGGYGGGGGYSPAGPHHGGMDSSNWSAQVLRLRGLPYSANEQHIVQFFNGFHMAAILPSTIPIDGRPSGEAYVQFVDAAEAFRAFQAKNGARMDKRMIELFPSSKQEMEFAAQGGDPRVFRERNRAY

SEQ ID NO: 82 - protein, 766 aa, Neospora caninum
MAKPEQDCKTAAALIRAGSLIEGVESAGKDFFVWTTQGPAVKKDPDLLFSLCRVLPGSTQQTLKLQQVEPTAEAGELTVQAKDAWQSNYGINPLTYGDIGGLPHTNEPCVLDFLAQRYQNHVIYTTAEPLIVAVNPFEDLKNAGPETIALYRDAADVDKLPPHVFYASRRAMGNLHQLKKPQTIIVSGESGAGKTETTKMLMKYLATSGGGNLDLKIQTAIMAANPVLEAFGNAKTVRNNNSSRFGRFMLLDVAREGGIQHGKVVAFLLEKSRIVSQDKDERSYHIFYQFLKGAPDHMRHRYMLQPLDKYTFINPHCLDAPGINDTEDFEQTVKSFESMNLTEAETCTIWSLVSGVLLMGNAKPTGKTEGGVENAASFVGDSEAALRNACTLLFLDYPSVLHELTVKTTYAGNNKIESRWTVPDSEMLRGSLAKGIYEQLFLWIIRKLNADIEPKGGSFDVFMGLLDIFGFEVFQNNSLEQLFINITNEVLQRNFTEIVFEKELQLYSKEGISAKKIEYTTNEKLIDTLLGKGSSVLAALEDQCISPSGTDEKFVSSLASKLSGNKSYIPSKNTKSFEFTIVHTIGKVIYNADGFSFKNKDVLRPEIIEITRASTNEVVRVLFEGIKVEKGKMAKGMLIGSQFMTQLKNLMEEFVAQFRFINLSVSNKAGVDAKTTCLELLKSTSLSADEYALGNTMVFLKPQAAKMLVRLQREALSAWEPLVGVFESVTVFRRARKSSADRAVPATRICANVRRKLLQAGVKVSA

SEQ ID NO: 83 - protein, 643 aa, Neospora caninum
MPVEGQVAEAGSLPVDKREAGSPVGVDEDDSLSPDSRFSVSPSNQAASQNAEGEGLDDAALDRMMGEKVRFENDVEEFLRSLYDEVYDRNVDAIRRLYEVEFPALTERYYAERRWPSVDEVGTFYRQFDRYHCLIITLYKELYYRHLFLKCQQEITWEDRRLAWENYALLINFLAEVECRPDDQKDGKSLRLPLQWLWDILDEFVYQFQEACRWRQRIARRLPEDEQERALFLKEMDKDCDVWKASQVLEFLHALVQRSDVQDLLRQPKDDATKNKLFESEIRFQLGYFAMILLLRLHVLMGDYFVGVKSVENIELTSRGFYWKVPAAHVTLFYHLGFAYTMMRRYTDAIRVMSQLLVFVSRQRSYLSAHFYQQMAMNKAVDKMYILVMLCSSLCNVKLDESVNQMIKEKYSDKFYKLQQENDETYCDLFTWACPKFINPATPSFEDPQALERFANSYSEVQLRQCKMFFKEVEFHKKISTINSFAKLYNNIQLSKLASLMELADKDPEDAVRSEILSVKYKGRQKVWRSGSLLSGDLTQSSSDNSVEFYMDQDMIHVRSQQSQKVYVDQFLKQIERSQHLFNSIQNSNNSARAGQRENRGPGGDRGNQGGDRDKFERSQDRRGHGVHSGANDMPKREQTALA

SEQ ID NO: 84 - protein, 582 aa, Neospora caninum
MKFPSSVRLLAVRQSQTLGHTPCATVAAGRRILVPAPAATGFTSFPRSHIGPEVCRRPSAATLGAAPSVLGHGSAKHSQQRQYATLGSGWSFNKVQYTKYRITKPWTTDTTFDDLILSQPSKEDFAKFTKEAPLFLRFLKLVTDVEGRQEAFIQFARRCENGLTVEKDVYVTKKELIDCLWKNGYTDTEINAFEIAFPGDYKFHYPELAVLFDLTEEDCYKYCIRQRAATPEELVELKYTKPKNLVSSYGLCFLGVWFGLSNTVLSNAWFYSKTFPFGAVFYMLGSYFYRDIREKLWKEEKSLIHTAQENKHMGEESVYKQMKKYATDTKCLDYLSSFRTEVEDQIANYKVALVSQMRRQLTERLVEKLNGIQQAEKLIQGSLQDVMIREIVSSFKDLYKSRPQLHDDAMQSAIQGLSGSDSAMDPVGAHFKASLQELAKVNLATAAADPMGTVVQRVAAVFQKREKEFLDTFTVKPTEAQEIKKIVEKCHKGNTFDFHALPNEELRRLEQLYSTVNNRVGFETIHEDSIKPVAALSENSKGFVDFVNTQRTCAIRKQWALAMISDIGAAGFHIKNEEWFFC

SEQ ID NO: 85 - protein, 1079 aa, Neospora caninum
MELSSEKARAGALSKHRASPSSDCGTVSSSPDLLSSLQDVNVHTKAHVLDAEEVVHQLKADAKRGLSEEEACERLEVFGKNELEHDAGKSLLQLILEQFQDLLVRILLSAAVVSFVLALFEGGADEGITAFIEPLVILIILVLNAAVGVWQESNAEKALEALKQLQPAQGRVLRGGAWRIIPSAELVPGDIIDVRCGDKVPADCRILALKSTTLRVEQSQLTGESVTVSKDVEVLPASYADCEVQSKSNLLFSSTTVASGHGVAVVVATGMRTEIGKIQSAVQEAGADEEDQTPLQQKLDEFGEILSKVIFLICIVVWVINIKHFSDPVHGSFLRGCIYYFKIAVALAVAAIPEGLPAVITTCLALGTRKMAKKNAIVRKLASVETLGCTTVICSDKTGTLTTNEMTCVRFCVPNMRHGTDEYTCEGSCYSPIGAVNYGGASHGQHRMFHHIEESDENLHWFARCATLCNEARLDIAPGSNGTKFTRMGEPTEAALLVLVEKLGCMDSTLNARFLQCEGRKEQAPMPFCEYWASSWSSLATLEFTRERKSMSVLCRERNSPQNTLFVKGAPESVLERCTSVLLPNGTVTQLTDAIRKKIQNDVDSMAADALRTLALAMRRDCGELSDYDSTSPSESKHPARKLLEDPSNFAKIESDLIFLGLVGLMDPPRPEVTAAIDACRGAGIKVVMITGDNKLTAQAVASMINIVDDARVGNCSFTGKEFEALSLEEKKEVLSQDGVIFSRTEPKHKQMIIRLLRELGETTAMTGDGVNDAPALKQADIGVAMGIAGTEVAKEASDMILADDNFSTIAFIRYLISSNIGEVASIFFTAALGVPEGLSPVQLLWVNLVTDGPPATALGFNPPDLDVMKREPRHREDKLISSWIFLRYLLIGIYVGFSTVGIFVAWFVTGLDNQADPHTLVSLSQLMQWNKCPSWENFKVTPVYGMKADDPCSFFTVGKVKASSLSLTVLVVIEMFNAFNALSEDASLLQLPPWTNPYLVIATFLSVAVHCCILYIPFLSRVFGVVPLTTVDWVYVILWSLPVIVIDEGLKAIGRMKEAARRRQLSLSRSQSQVRKTQ

SEQ ID NO: 86 - protein, 458 aa, Neospora caninum
MALTLARRSFALYALLACLSVSSPFSGAEAGLYSPNGPVKVLSSQQFKETVVNSNDLFIVEFYADWCGHCQRFAPEFEKAAKALRGIVTLVAVSDQAAMGEYGVQGFPTVKAFVGRGGKPPKTFDYNQNRDAASLIEFAMMHAGKLAKARLAVGFLFFAKRGIFSREKGQVRFVFPGKIDAGADAKPSESTPPKKDGPSDVIELTDANFNQLVMKDDKSVWFIEFYAPWCGHCKALAPTWEEVATALKGRVKVGKVDATVEKVIAGTYGIRGFPTLKLFPAGEKSVGMVKDYEGPRTTEALLKYALEFFSVNVTAEQLLTEKQFRDACGDKLCVLAFLPHILDSKKEKRNEYLATLNQVVRASFHMPITFFWSQGGDQFEFEEQLNLAFGYPAVVAIHLSKGKYSIHRGDFSQESINTFITQLLAGKAPISELPKNLKKLEDARAWNGEDEELPKDEL

SEQ ID NO: 87 - protein, 103 aa, Neospora caninum
MSGRGKGGKGLGKGGAKRHRKVLRDNIQGITKPAIRRLARRGGVKRISGLIYEEIRGVLKVFLENIIKDSVTYTEHARRKTVTAMDIVYSLKRQGRTLYGFGG

SEQ ID NO: 88 - protein, 387 aa, Neospora caninum
MIFRQGRACVAALGCLVAAVHVFGNLSLDCVRATSVGSVGKNTDDKGKVASTKIDLDPEDLHGHVYLPLVEQVDPMRLEEHECRYPADGEGVGRLDLRVTENLIVGFHCHGGTTEELTPDKGSAAFRVNSDGYCDTTTVVDVDTLTPNALFYQPSQPDGRLVGNAVFFAGGLPLDSEKKACFVCKGKTVSNKGKSCEVIVTVPKASLPNSWVCNPEAPPSVNTLAFRDDGTAKEAFVHCPPGYSKLDSPDKDGYVMTGPQCMTKAKLEDVLGSGSTIKTVELKSPPSGVSKSYQVTATSSFPKPRMLCMKCFPGDSEDKPSETDACLLKVLLPVFGEKGKEAGKTLEQTTGETETPSETTTSAGVVLSCATSAALLAPISVLMSVAM

SEQ ID NO: 89 - protein, 756 aa, Neospora caninum
MASHSSGTSQAFVRRSVFAVLLLSTLVSGVFAASGNVSGTSPGELVSLVQAASNEAGDQLQTCTKVMDLLLLVDDSASIGSRNFEQVRKFVLDFIDLVPISSEEVHLSVVTFADSPQDVFTFKQPQATNKQLAKEAFKYLRYRRGGSTATDKGLIRARRYLTRPVYGTRANVPKVLVLMTDGESDRHYDTIQAADQARAEGISVFVVGVGMANPVECRGVCGCGRYGPCPQFIMSNWNELVQTVDSIMGEVCKKLPKDAECSEWSEWSGCTASCGAGTRTKTRKQLSPPLAGDPPCDNCEPMMGKTCEDLGGLVRVEDCNQGECPQDAGCGTWGEWTSWSATCGHASRSRKREGYNTPPPRGAGLLCEQKRPPVPREQSEETDFAPCPRNQVPGEWTDWSVCSATCGGGTRHRSRSGSPQVGELYGGQTLQEQGIEVRQEEACSQNPCPVDAVCGEFGEWSECSRSCGGGVSVRKRDPWNNDQQHGGKSCKQQFPEGREETKECNPEPCPVDEVPGDWIEWGPCSVTCGTGVMTRQRGPSRVEARFGGKTIAEQNARLSSPILMQEEKECSPFPCGPCTYEFGPWGTCRGTCNDGFKIRHAAVRFDYTDAPCNLPTMEVDTCVPEGCSDAGTTVPGTGGEPGGTGGESPNESTNNTGNSSGSTSGGAAEETTTTDEDKDEQGGIPTAAIAGGVVGGVLLLGAAAGGGYYMMGSAGASAAGEAASADFLGDQQTAEVEAEDKEEMFGVDEDSEMWSA

SEQ ID NO: 90 - protein, 557 aa, Neospora caninum
MSPCTFLLVFLLFFCITGLGRAYSAQRSIEHHNGVTKRRLPHSAGLEKSVSAVQYKNVPFSARATGPFAVQQSQTGPNFVQLTSTSQVPRRRRRQRERNVNSEEPPMRSGNRHWGWLSPRAWLRGAANRLGRGTNSRRCNESPEIVLPPGIAVIATLLQQLREEIEGFSVQQRDNPQLERTAELFFPPGITKTVVSKACGDQRNIKYDGIISSGTWSTVLRVIDTGEKKQYALKVRRLRGALSLESGYRSILEEGRIYRRCKPFGRSAAHAFRRLKLMVALDILRLEGVRSFVKRSDFRQTIANLFLLMPLAKTDLLSFLQALFSRPPISESPSGFQARLKITAEAVTIVANLHKQRLVHGDIQPQKMLIMPNGSVVLGGILDFRRSGRRCSPDLLAVPYLPPELLDEECVYSYLTDSWQLGLTLYQIWCLRLPFGLMTPVVADDPDYYVVEEVLRKPDAELSFEQAGCVANIPEYVESLIKQLLQFNPENRLTPARILVSRDFNRLGAHVDHLERSARELVGSPPPQGPRRVGWGLSGLQDGTELQSNNTNLESQN

SEQ ID NO: 91 - protein, 225 aa, Neospora caninum
MSLPTFASPYNVEKRRFNEERVLMQSQKDGVEGVNLQMPPNYGDMDLILFPEGSLKNCNNTIIPQSHLKGKSVALYFADGADPKCASFLPFLLNYYRTINEGGSNQKVEVIFVSLDRDRKSFESHRSHMPWLSVDLENPLTEVLKRHFRVMKEYEVPTYGYGSRTGVPCVIVIGSDGREAQFLPISSGREEGDRALLRWDWRNTKFASDQFLVRQTCQEKQGQSH

SEQ ID NO: 92 - protein, 260 aa, Neospora caninum
MGRVIRAQRKGRGSVFRAHTHKRKGEAKLRPLDYAERRGYIKGLVKDIIHDPGRGAPLAEVSFRDAYRYKLNKQRMVAVEGMYTGQFIYCGKNAALTIGNVLPLNKMPEGTVVSNVEEKAGDRGTLARTSGTYATVVGHSDDGAKTRIRLPSGARKTVSGYSRAMVGIVAGGGRIDKPMLKAGNAYHKYKVKRNCWPKVRGVAMNPVEHPHGGGNHQHIGHPSTVSRMAAPGQKVGLIAARRTGLLRGGRKTKLAGKSQE

SEQ ID NO: 93 - protein, 196 aa, Neospora caninum
MMNFKKKIVKPQGVEPTEIENEVAKCLFDIETSSQSDLKGEVRHLVISSVKEVEVPQGRKKALVVFVPYAVYQKTVKRIQGRLVQELEKKLKKHVVLIAQRTMLPLDFKRKGLKVRPRSRTLTAVQEGMLEDIVSPTEIVGKRMRVRVDNTKMLKVLLDPRDKQKDNIEDKLETFAAVYKKLTNKDAVFIFPQHVY

SEQ ID NO: 94 - protein, 623 aa, Neospora caninum
MAGALFGVLALLFALSASVSGPASRASSTLFRFPSPLGVSAAAREAGVVNAEDEAARAGDAASDKSTKSYSLKQQQQTRENKLKVLESGAMSLSGLETYKEFLASHPFVLVMYYAPWCYWSKATLPEFHAAAKILAHHEPPVILALVDSVEEEDIANFEDIREFPTLKFFIDGRGQPYQGRRHRTHLVHWVETRLDRDKSLTSTQHLDEMMSNREHGHLVIVGAFNSSGFDANAYVSVARRFGEDVFFGHVQDAQLIDHLRQHIRRLQKGKIPADVERRLANPPFIAVFSKHAHEPDVHLYTGNPSDVAALTSFVGRFRFPLISIFDADRLPENFFTDPRPKAVLIVDTKANPNALAAVEAETSTDPVVRAFLQGARKHRQSLLATVCGVNSPFEKHMLELLGVDEDALPALRIMSVNADSEGPHHPALKFRPEEKSSGRSGQARVPIRTLSPSVVSTFFDDFVGRKLEPYFRSEAVSDEEEPRGTVKTVVGSTFQQLVKDADGDVFIEFYAPWCGYCRKLEPAYKELAARLRDVPGVTIAKIDATRNEVPGMKVPGYPTLFLFPHGKKHDPPLVYSGERTVEDMLEWLQTRVAKARFDTNRLLALDLRARGGEAVGSVLEEL

SEQ ID NO: 95 - protein, 656 aa, Neospora caninum
MWTGRRLVLSAASRLTGSTATPLKVVSAPAPLSALCSHPRIGAGCSSLRPGQGQLSVPLVLPGKRCLLTVSRPVLAVKTFKLADIGEGIAQVELLKWHKQVGDHVEEMDELCQVQSDKAAVEITSRFTGTIVKIHQKEGMMVKIGSPLMDIDVEAGDDHAEEEEPEKHEAHPTPVSEPKTPAPSPSAGSASSSGNSFSASPATRRFAAEKGVDLSRVQGTGKNGLITKEDVLKFLEAPHARSPPPAAQSPASLASGHTQDSARNTENADQSGVCPRDQAEERVPGLSCLTSRSPSVLKSAGDSDAEVETAVSESRNEHADPRSSAHLSRRAAPGGSGASGSNSSVSTGPSGVRTAESEETYGAPGASGVASPLSPAFLHAPDASPLPTDVASAGSGSAPPQARPVAVVPQRPQRETTQVALTGFSRAMVKSMNETVKVPQLNIGDEYDITELVRMRESIVAYTSKKYNLRPTITAFLIKAVSIALDETPILNSKFNAASGDSYTQYGSHNISIAIDTMNGLVVPNIKNVQDLNVLEIQAELHRLQDLAASNKLSPADLQGGTISISNVGVISGTYVHALLFDGQACIIGVGQARDMPRFVERNAQTLDEDLVERRKIMTCAFTADHRHCDGATVARFNKKVKELLEHPEMMLLHLR

SEQ ID NO: 96 - protein, 951 aa, Neospora caninum
MALSFARRPAAGVKLAVLVAFLAVFCPVLPNLFSKEDSLGRPVPRGVLVTDAAAYANKKVSVSEVSFDSHIEDIQWCGVDHRTILLKTRRGRLYRSQDGGKSWTEITDLLKPSEGSSAAVAVDSIIVSPVDKRVVLIVGSKRNHFISEDSAATFRRLKYKNTIHNFHFHPTRPKFAILSTWTDACYASGGSGTSRTIQQDCNHQLFYTRDLGRSFKLVADYVVQFSWGDKKLGNTDHIFFTQHRGRSGDQPRYGGWSKNVDLMYTPDFGATITRLVYRGNKFLLSNGYFFVAKVKDAGKQTVSLLVSTDGGKSFQMAKLPVEIEERSYTVLDTSEDAIMLHVNHGHGSKGDTGNVYISDAKGVRYSLSLPNNIRTSTGECEFDKVLSLEGVYLANFKDTIDASATGSEGAASEKNQVDAAGEKLTEEEIEEEAEGVQVDLEKKHRSVATRSRQEEVIRTVISFDKGGVWSYLKAPRVDSRGQKIDCPPDRCWLHLNGITRFSDFAPFYSVENAVGIIMGTGNVGSYLRPEKDEANTYLSRDGGVTWIEAHKGAFIYEMGDHGGLLVMADDTKKTNQVVFSWNEGQSWYDFELGASPLFVDNIVIEPNASSVEFLLYGKREQDTAGVLFHLDFNALNQQQCKGIWAADSVSSDYETWSPSDGRAGGEKCILGKHITYTRRKQTSECFNGRDFDRPKVSKVCPCTMEDYECEFGFARSIGSTQCVATDAAAAAAATATGLAQFTDENDAAAAAACTSSSFFYTSAYRKVPGDVCEGGWMPEKVAVPCPAHSPVSRGGKTVLLLLLFIVVVMIVINYLSKTGKLKKFFRNAGFDNFANVSYGLVGGSAAGPGSWLDQEAGEGRRGEELGDRSKYEPELGFIEAEQDENEEDAPTLMTYGNAAGGQRANSGIASRSPKRKEEDEFEFEDAGRPLFPSHIPRLAPPRFDEENVELL

SEQ ID NO: 97 - protein, 166 aa, Neospora caninum
MAPKAGASSGAKATKKTVAGKVKKAQQAAKGLKASSSFKKARVRTNVHFFRPHTLRKARQPKVVRRCYEAATCTFPKLAKTDKYTIVRQPLTTESAMKKIEETNTLVFLVDPRSNKRQIKQAVKELYDVDAQRVNTLIRPDGMKKAYVRLTSDYDALDVANKIGII

SEQ ID NO: 98 - protein, 1028 aa, Neospora caninum
MTRGKKHPKQGLSFRVPESCCFSFCESVSGRQLNSLVKPPTLSTPFPTGAFFPPSPVSCVFAAFSQAERTMSSFTGPSSVRLRPGVLCVFLSLLSLSLTCVPFSPSSLSLPSSLPSSLPAAYGIRLDAAQPVPPQPDSLPVAGATDSCREPAGAFDGADGVPSLREAEEILRREQTVATEHAQRAAEDVQQFAEAAREAAAKGDIAAAHELAAAAAAAAAEAQDIAAYAQAVSETDPALLRERAQEEAHRSAESEARRQQAASESQANAAEQGLPYGSCDVTITPDDIASVPEALEKLAALETSVQEAGEQLDEKEQMVAEYMLAASEAAERHDEASRAFEDAKKQKKENLAAAAEKEALEAAAEYEELATAVQVLTEEAEAQSGKALADAVAAGEMRYAINQKIVSDADPAARGKVPRSLLAPKHFHISDAASGRVLKIYFHNSFAPFDDLPCAALHTDAYLCRQHPRCVVQYEQSGDEVLQRCILDDAYLWLVASTSDFCAAAPEGSSQAAASPFDNATPLEPMAAVTEEEIEAVALDLLQESGVDGPAVLEQMAKDGKSTSDLCGFVQALSAELLRTERDPRCASPADDGENIALTTEALLASNFGFLGPAAPATASPSASAAAPAPRSASIRSHNRNAFAAGGAGKNAFAPVPRISPSGLFGLLGGSSAKANAPIRMGINGMGRIGRLVFRIAMTRPDVTVTHINCSMDPAYIAYMLKYDSVHGRFDGEIVPTDSGLIVNGQEVSISNTRDPEEIPWAAQGADYVCESTGVFCTTEAAAKHVNRPGGAKHAVISAPAKDESTPTLVVGVNAEQDYESSMKVVSCASCTTNGLAPLVKVIDENFGLVEGLMTTVHAATGTQKVVDGTSKKDWRGGRAATGNIIPSSTGAAKAVARCLPHMKGKLTGMAFRVPTLDVSVVDLTCRLNKSTTYEEIKKAVREASETYMRGIIGYTEEPIVSQDIVGSQCSTVFDANAGIMLNPNFVKLVSWYDNEYAYSARLVDLIAVMAAKDGVVAAGTGLDRKPF

SEQ ID NO: 99 - protein, 505 aa, Neospora caninum
MAAQAAKADAAMAHAAAASRDYRVAPRLDYRTVAGVEGPLVILDDVKFPMYKEIVNIHLGDGSVREGQVLEVRGKRAVVQVFEGTSGIDTRQCHAEFTGDVLKMPISEEMLGRAFNGSGKPIDRGPRVLAEEFLDIDGCPLNPQCRVYPKEMIQTGISAIDVMNSVVRGQKIPLFSAAGLPHNEIGAQICRQASLVAGKDVKDHSDENFAVVFGAMGVNMETARFFRQDFEENGSMERVALFLNLANDPTIERIITPRLALTTAEYLAYEREMHVFVILTDMTAYADALREISAAREEVPGRRGYPGYMYTDLSMIYERAGRVEGRNGSITQFPILTMPNDDITHPVPDLTGYITEGQIFVDRGLHNRQIYPPINVLPSLSRLMKSGIGRGMTREDHPQVSDQLYANYAIGQDTRAMKAVVGEEALSPDDLLYLEFTDKFENRLLTQGPYENRSIFQSLDIAWELLRIFPEDMLKKIKEEELRKYYPRDKYLEEQERNDKRVPPS

SEQ ID NO: 100 - protein, 412 aa, Neospora caninum
MRTAPATLEKMVIAVSPEEQPATPGVPPEHTVTGLKGEMAAMAANDDTAKQLSAEPKSAAHTHLPWEIPCQQSGEGNRAMLEQGFQATREQIEKNAAGVRSMISVVIVWLVITGVLLIFAFSPVNVDLAIVSMLLGVFIGIIGILAVSTKNTTGLQLYLALDTVLLLLTVAVWGYYIYILFCAARAALDIAADPAYHSVSDASPELLPDRSRSGVGEVTSIEAAERQEGLSSIVRLDETLEPCKKGLSGYGANYFKRVTSVFGGLATRGQMCNYSHYDILDFRKWPVSCRGTCGFDRLATDYALDKTLLDDQKVIAEFLSQLKYLPPQEATACVKYSIRTACVAENTAYHYVILAVIACLILWSCCACLCWIPASLCVAGKHLSDLRKYQRAREAVERGAPSGAAQIELAGV

SEQ ID NO: 101 - protein, 530 aa, Neospora caninum
MFRFLPRAASGASTALSVHRRRIPALASLPASSSSLIQTRSLFGAAAATTAPSGVSPLARSPDLSIPQEAFNQSPTITTTLPNGIRVATQRLPFHQTATVGVWIDSGSRYDSKETNGAAHFLEHMTFKGTKRRSRIQLEQEIENMGAHLNAYTSREQTVYYAKAFKKDLPQCVDILSDILLNSTIDEEAVQMEKHVILREMEEVEKQTEEVIFDRLHTTAFRDSPLGYTILGPEENIRNMTRSHILDYINRNYTSDRMVIAAAGDVDHKELTALVEKHFAAVPQPKKNKIILPTEKPFFCGSELLHRNDDMGPHRPCRCRIRRRPVEVPRKADLCLRCAWAFADAVTFMLMQAIVGSYRKHDEGIVPGKVSANTTVRNVCNKMMVGCAEMFSAFNTCYSDTGLFGFYAQCDEVALEHCVMEIMFGITSLSYAVTDEEVERAKAQLKTQLLGHLDSTTAVAEDIGRQMLAYGRRMPLAEFLKRLEVIDAEEVKRVAWKYLHDAEVAVAGLGPLFGMPQLINIRRATFWLRY

SEQ ID NO: 102 - protein, 261 aa, Neospora caninum
MKLNLANPQAGMQKTVEVDDEKKLLPFFEKRMGTEVAGDSIGDEFKGYIFRISGGNDKQGFPMMQGVLVNHRVRLLFRKGMKCYRQRRTGEKKRKSVRGSIVGPDLAVLNLVLVKKGPEAIPGLTDAERPRRLGPKRANNIRKLFNLSKDQDVRKYVVRRQIEGKKKTKAPKIQRLITKTRVQRKRAYLAKQRRSVIKSREEAKAYKDVLSAYKHELRKKRADVVAKKKAQTATVAAPVAKPAVVKKDVKAKAATAKKGGK

SEQ ID NO: 103 - protein, 950 aa, Neospora caninum
MAPNPRVVSRLSPSLSLIGCLLPLFILSLTALFPYALESVQKHPADLLDNLTCTGPAAASLQWEASPSLSIGSWEQLPCVDASSVNLLASSKDVQAGNILLLVDIDDTLIASGGWHEVMGRSLGGLDSRYGRGSDYPGFGAVLFLLALGPHARNLRTGQLTEYSLPSKIMLVTARPNLPLFRPDHLVPHVSTILARGARQIMGDEAPEWGVGSQNSMRPANALRGMRGRGENKLSYMVSVLSEGQPVAESRVDEQTKVMFIGDTAESLVLALFLFSGPSESASVLSAGVDCVSRDLEVAVGLTAMAPEKMIAHFLHVVYAHNVADPTQLHAPSQSAPEKLDEDWIVNKVSQVLQDVFSGAARTAAAVTRALKEKDEREKKRGAPSRAPPESPQTNKQKVSVHDALGNTTRFGIKVGNALVDAIAIVYDVLVTSDDEEGPRRCTDLSAADAFEVGVLVAQKVRLILDLYQHRWHRTYAAFRAQEEGEAAGSAVPPRMLPVIFVQCGSVKLRVAHDARPQAPLDAYVSEMQGGRSRVSVRFRGTDTLKAGNHVDAESLQSNMLDSLGIPIVPFVTSISAVAQAYVLGTVDLTDVLVVVRKTYESLRSQGPLAQPARLPALLDHYYDLLSLRALLFPGGREALPPDAPARVRATVDYLDELVKVQKAFVKRSAYLRAVPDRTESCIRELEQIAETQYERSLRQRASGDREGVSFSRSQFVAFTTAFGELVCPYDVELSSVHFAGGAEVQGLAVYVSRFARQALSAADTAAYSKAESRKATHESSANHDTSAERVEGSSAEAKDVTKGQAACPLPVDVRATFAAMYEAFCAEVAGTVCRLLESRLLSSGVLADFIFLAQERGKGNAKPLRLPHLGRVVFADEQGLEAFEMHHRKPVRDVFGSLGSKLDEAIMEQAASGFSFTKWPFADSWSRWKHVAGDLQLIVDCDLLTHGKP

SEQ ID NO: 104 - protein, 1239 aa, Neospora caninum
MSKMFVKCETKSSRVKGLAFHPSLQWVLAALHNGTIQLWDYRIGSLIDKFEEHEGPVRGIDFHSSQPLFVSGGDDYKVKLWSLTTRKCIFTFLGHLDYLRTVFFHHIYPWILSASDDQTVRIWNWQSRACIAVLTGHNHYVMSALFHPYEDLVVSASLDQTIRVWDTSGLREKTGGAGGAHAFGKGSFPGGPGGRHHASEMFTANDAVCKFVLEGHERGVNWAAFHPSMPLIASAADDRMIKLWRYNDSKAWEVDTLRGHFNNVSCLVFHPQRELLISNSEDRTIRVWDVSKRVGVHTFRRENDRFWIIAAHRTSSALAVGHDSGMVVFKLHTERPPSALHSRFHFYYIRDRVVCFRDLQLTLQLSHKHGDARNAPGSLGGGNAAGLAAAAEVSICEVRRPANAMTAGPKYLLVNSLNATDLNAIVIYADAESGFSYDLVVGPLPQAGLPYPGSPETHTGSCHSVAFVARNRFAMIDKAGATSLGVYNMNNELCKKVELPCPVDRLFFGGNNRLILKSEDKLRLFEVPTCRVYPEVQCGGGGGIRSVLLSPTGEYLMVISKHSLMLLHHVGHADGGASDATGGFEVVCAVHENIRIKGGAWDEDNGTFVYSTLSHVKYLLLNGDRGIIHCLNEPVYIFKVQRGMYYYLDRRAGVHVEPLNCQEYLFKLALHRRQFDQVALFVRNGQLCGNALIAYLKKKGYPEVALEFLTDKKARFHLALESAWQLLGRAALQQGYPSLVESAYQKLKEFEKLSFLYFITGNIGKLRKMLRIAELRKDPMSEFHNALLLGDAEERVQVLAEVGQIALAALTAKTYGLTALYEQLHDSVKDMSLDTFMPAVPQLLMPPIPILRCTEAETSAWPSAVSEGASVFDKAMQATAGMKPEAAGARLYKDMVEGASAGATAGAPPAWEDAAEDLDGFEVDLGEGVAGGDWSDGIDLPPDDAGLSQLGGLDEPAPGKETLEHGFDGAGSSFVAKREPPHAAWLKGGQPVVADFVAAGEFSLALETLQRRMALRNPAPLLPIFSRVYQAAWASLPGLPFAPSLPLALSDRAAGKGAAGDGGLKPHRLILPSSLMEDLREAHKLVTAGRFQEALSAFRFVLHSVPLVVANNAEEEQQVHEFIEIARHYVTGMILEMARLSLGESDPGRNVELVAYFACCKMQASHLFLVLRRAMSVAWKAQNFVTTAAVRKCIRARKAYVSSPGVARRLQSRLGIQGSIWALQHEFETRVDRKSRGEG

SEQ ID NO: 105 - protein, 2552 aa, Neospora caninum
MLPNGSGGFRPPPPGGSGVHPGPPQVHPCPPTGHLPPGLLPPPPGFPLGFPGSLGPPSSSAHPGGLFVPPQVPPAPAASSLPNAPSQRLPPGGMFMPPPGFAGFQQPQTGATRPLHMSPHAQTPAGRGPGGPGPSGHKGVPGHGPGASASPGLSGASPSPPGGAGKSPFYGKDTRKLEGPSSSFPTGAPTKGESGHGPAHPSVFARYPPPLPGPGHGLAGGPPKEVRPKIKSAEELLAEKARKWQQLNTKRYGEKSKLAGAGQDTTKEEMPPEHLRKLIKDHGDMTSKKFRHDKRVYLGALKYVPHAVYKLLENMPMPWEQVRNVAVLYHITGAITFVNEIPWVVEPIYLAQWGTMWIMMRREKRDRRHFKRMRFPPFDDEEPPLDYGDNVLDVEPLEAIQMQLDEEEDAPVIDWLYDSKPLQHDPRYLAGPSYRHWRLEIRQLSVLYRLANQLVSDLQDKNYFYLFNLESFYTAKALNMAIPGGPKFEPLFRDLHEEDEDWNEFNDINKIIIRQQIRTEYKIAFPYLYNNRPRKVAIAVYREPTCSFVKPEDPDLPAFYYDAIVNPLPAYKSGSSTTVHQDFSVFENFVLPREIQPLLQDAPLSTDTTVDGIMLYWACRPFNLRSGRTRRSIDVPLVQSWYREHVPTNYPVKVRVSYQKLLKCWVLNHLHQRPPKSLKKRYLFRVFKSTKFFQCTELDWVEVGLQVARQGYNMLNLLIHRKNLNYLHLDYNFNLKPVKTLTTKERKKSRFGNAFHLCREILRLTKLVVDSHVQYRLGNVDAFQLADGLQYTFAHVGQLTGMYRYKYRLMRQVRMCKDLKHLIYYRFNTGPVGKGPGCGFWAPVWRVWLFFLRGVLPLLERWLGNLLARQFEGRVSKGVAKTVTKQRVESHFDLELRAAVMHDILDTMPEGVKANKARTILQHLSEAWRCWKANIPWKVPGLPAPVENMILRYVKMKADWWTNAAYYNRERIRRGATVDKTVCKKNLGRLTRLWLKAEQERQHAYLKDGPYITGEEAVAIYTTAVHWLESRKFTHIPFPPLNYKHDTKLLILALERLKELYSVKSRLNQVQREELGLIEQAYDNPHEALSRIKRHLLTQRAFKELTLEFMDLYSHLVPIYEVDPLEKITDAYLDQYLWYEADARHLFPNWVKPADSEPPPLLVYKFCQGINNLTDVWKTSDGEAVVLLETKYEKVYEKIDLTLLNRLLRLIVDHNIADYITAKNNVNINFKDMNHINSFGLIRGLQFASFVFQYYGLILDLLILGLTRATELAGPPNLPNDFLTFTDVETETRHPIRLFCRYIDRFWIVFRFEKEEARDLVQRYLTENPDPNNENIVGYNNKTCWPRDCRMRRMKHDVNLGRAVFWEIENRLPRSVSTLEWSNSFASVYSKDNPNLLFEMCGFEVRILPKIRTYTEEFSQREGVWKLQNEVTKEMAAQAFLKVGDEGMKRFENRVRQILMASGATTFTKIANKWNTTLISLMTYFREAVIHTEALLDLLVKCENKIQTRIKIGLNSKMPSRFPPVVFYTPKELGGLGMLSMGHILIPQSDLRYSKQTETGITHFRSGMTHEEDQLIPNLYRYIQTWESEFIESQRVWAEYALKRSEAAAQNRRLTLEDLEDSWDRGIPRINTLFQKDRHTLAYDKGWRVRQDFKQYQQMKAHPFWWTHQRHDGKLWNLNNYRTDMIQALGGVEGILEHTLFKGTYFPTWEGLFWEKASGFEESMKYKKLTNAQRSGLNQIPNRRFTLWWSPTINRANVYVGFQVQLDLTGIFMHGKIPTLKISLIQIMRAHLWQKVHESIVMDLCQVFDLELDSLEIEMVQKETIHPRKSYKMNSSCADILLFAAYKWQVSKPSLLADGKDVMDGTTTSKYWLDIQLRWGDFDSHDIERYCRSKFLDYTTDNMSIYPSPTGVLLGVDLAYNLHSGFGNWFPGLKPLMQRAMNKIMKSNPALYVLRERIRKGLQLYSSEPTEPYLTSQNYGELFSNQTIWFVDDTNVYRVTIHKTFEGNLTTKPVNGAIFIFNPRTGKTRARQLFLKIIHTSVWAGQKRLTQLAKWKTAEEVAALIRSLPVEEQPKQLIATRKGMLDPLEVHLLDFPNIVIKGSELNLPFQAIMKVEKFGDMILKATQPEMVLFNMYDDWLKSISSYTAFSRLLLLLRAMHVNTERTKIILRPNKTTVTQSHHIWPSLTDEEWIHVEVALKDLILADYGKKNNVNVASLTQSEIRDIILGMEISPPSLQRQQIAEIEAQTKDVSQVTATTTRTVNAHGDEIIVSTQSPHEQQVFSSKTDWRIRAISAASLHLRTHHIYVNSDDIKESGYTYVLPKNLLKKFICVSDLRTQIAAYLYGVSPPDNEQVKEVRAMVFVPQVGSHQTVSLPQTLPEHAYLADLEPVGWIHTQPNENPQLSPQDVTAHARILNENKTWDAASTVIITCSFTPGSCSLTAYKLTPQGYQWGKSNKDTGPNPQGYLPTHYEKVQMLLSDVFVGFFMVPEGGLWNYNFMGVKHSPSMRYNLVLDMPKEFYHEQHRPSHYLQFTQMETTTETAGADREDLFA

SEQ ID NO: 106 - protein, 221 aa, Neospora caninum
MGRRPARCYRYCKNKPYPKSRFCRGVPDAKIRIYDAGRKRADVDEFPGVAHLVSDEYEQISSEALEAARVCANKYMIKNCGKDNFHLRIRVHPFHVLRINKMLSCAGADRLQTGMRGAFGKPMGLVARVDIGQILMSIRTREASVATAVTALRRAAFKFPGRQKVFVSNKWGFTKFTKVEYKKWQAEGRIVSDGVGAKWISTKGPLANTFPSAADITIPVA

SEQ ID NO: 107 - protein, 350 aa, Neospora caninum
MRRFAESANPLGSSGAVVLRAPAGLAAWGQRRTERSALSLSRLVSSLVLLAFSPLFFGAFFSAAPAHLAEAAASKLSGEKLAELMQMDLKDIKERMLALFELIDANHDNEIDTEEAKEWSTKLKNAMHQHQVRMEFQAIDKDADGKVSLAELEATYVDGQDQKQLEQHKKEVEQRFKAVDKNNDGLLDMAEIRILMDPGKDDGLMKIEIEEILTAQDKDGDRKITLSEFIETEGTGSITDAEKAELEKEFKSYDVNADGTIDEGELQQIIKDPHAHEIRLLLEEFAKDLKDGKVGKEQWEKEFESFAVSMLTDNGEVLRFPEDYTGIEFPFKTVVPKVEGVEDDEKHDEL

SEQ ID NO: 108 - protein, 406 aa, Neospora caninum
MIFRQGRACVAALGCLVAAVHVFGNLSLDCVRATSVGSVGKNSDDKGKVASTKIDLDPKDLGQFGYVPPGDGRDPAGDEVQECKYPTDGEGVGRLDVLVPGSLVVAVRCPDGSSSDFTPANHTLAYTVNSDGSCDTTTAVDLDTLISHAVLDERKENDDPLLGSMRFFARGLPLATETKACFVCSKGKTGSNKGKSCEVIVTVPKASLPNSWVCDPLLPPGGNMVTFQGDGSEKTATVHCPPGYSNLDSPDEDGYVMTGPQCMTKAKLEDVLGSGSTIKTVELKSPPRGVSKSYQVTATSSFAKPRILCLACEPGKNEQVSSSAPNRCMVEAFLPAAAAEVSDGDSDLQKARNLNSQEPPSETGTSTVTTSTVTPSTGATSDGVVLSCATSAALLAVMSGLTAVAM

SEQ ID NO: 109 - protein, 909 aa, Neospora caninum
MFSDYPGRSSATHIPLISDMRSVRVTVALFWAVVAVVGFWASPDSRMTVAGPQFADAATGRVVKSLKRAMNQGWRNGAHSVCAILGCDYEQVKAHLAHHPASFHSFKAVCAQLDEFEEEITTSKQREEDLTPNQKEYRWLLLMKAAAVLNHCLGTKFSVPANFVPPHVKSNEYVPGQRGDGDEKEKLKSRMKALQVVVPLPTVDEIQNYASQRLASLRQTHMDQTKELEEARHRKFLLLQEEHDRQTEQMISELKLKQTEEMDTLRRELAEEKRLFDHSVKVWDAVSRLLTDAHLGIEALSERVHSMSQQVFKLSSFYDKLHSYQQASKENPTGNAAYSALSYAFQSEAAVEQAMQQIVATYQEASGAVARIQEILSQAEGVTATAPPRDDAPWFQQRQRGYKDRLDSFNNLLTDLSVRLEDLMQTAEERKLVILFSGDEVRTQTLALLQERTNDWSARLATLRERAQGIEVAASKFFESSAQLDRTTGEVVSAVLQNPDAFIVQVSTYATESGSLRSSANVIEEDLKNLIKALQEIGREMTGMTEGISAAQLPPAVLEFLGLPGLFNALNVDMQVKAKGQQMIQLIKARLNQTVEISRKLEMLKNEVKNIRSPAAREQAEWALSEVSTKLQDVLRAKAEVELEIQQINLQLQQAQATIAQLDQRMNHERLAAKRVAAGSSAAGGLRGNSLAFGGTVGGLGGSIDGLGTSAGSVMGLGSSVGGGLNADSRVTLVELEQQRQAAKEKLQELRQSLSTKQREAVSLENEARRLEAEVGTKQRELTEEQQRIVRTMTLAQSLTTGAAPTASMTMASLRGGLGMTGGLGGGSAALMSQGLMGSRATGMLGGSMGGLGGSMGGLGGNVGGLGGSMGGLGGNVGGLGGSMGGLGGNVGGLGGSRGGLGGLSRGGI

SEQ ID NO: 110 - protein, 1311 aa, Neospora caninum
MATPLGLLGSASSAPPSSPGSSFLRCREAPAALARPQSAPDSWACSRRPVGVASLLSSPFRAAAALTMAAAVASQAPSLTALLSSMCTQFAPAPVAPLAFSHPFPAACLPSTSKPGASHPLSHGVPTTFLASPTCAASPLSLSSILQQPAGRGGPLASPSAWQGRLFSVMPAATLALADQAEKPESLRHSADASPSHPAFDITSQEAVPELHLTATEYVHKKTGARVMSLTVPENETEKVFCICLRTPVADSTGVPHILEHSVLSGSNKYPLKEPFAELLKGSMYSYLNASTYPDRTCYPVASVNDKDFYNLADVYFDAVFQPRAIRDETVLLQEGWRLEVTSEDAKAEGDAVRLRGDGELDESRKRKRKLAFQGVVLNEMRGVYSSPEALLWKAQMETLFPDIPSYAHDSGGDPQDIKTLTFDAFKEFYNRFYHPSNAKIFFWGSDDVMRRLDFVDKNLEALEVPKTCNRAIEASSVVPSQPLLPAPTRVTRVFPAPKEQLEDLVTVNLVLDPMGFPVPTPFQRLSLTILSHLLMGTSASPLYRALTESGLGKQVIGGIEDGLKHLLFSAGLKGVPQQSEGGTSAVDKIEEIVLECLEKHAREGFTDEAIDASINSTEFRLREFNTGSFPKGLAVIQEMTAGWTEDRDPVDGLRFEGHLEELRRRLKSGEPLFENLLRNYLRSGLLSALCSAASARHFIGNTHRATIHLRADPDEEARREAKDKEEIEEVEASLSSEELDALETQTIELKAKQMAEDPPEALRTLPTLTLQDVDAEGEEIPTTIESYLDGRAALLRHALPTAGILYVDLAFPLHTLTLDELRYLALFGRLLVEAGTSTKDEAAIVHHIGRYTGGISSVTDIRTLHPNPREIADPYQSAGYFIIKGKALKSRIPELFSTIAEIMTDANLGNGRRGKEILKETLSSLEAAFLHSGHAMASSRILASLTVTGYISEQRHGHAYLEFIKDLKKQADEDWSPIQEKLVTIREKLLKAQREQLLINLTGDETTLEAATSPAHAGGRALAEAVQALRTGASSHHACLDGKRGVHPCPWGAELKKKHGLLQVKEEGTVGEGFVVPTRVNYVGLGGRLFAPGEPYVGASAVAVRALSTGYIWDNIRVVGGAYGSFFRSDFTGTFLFTSYRDPHLRDTLKRYLGAGAGLHQFAENLDERSLTRAVIGVLRDLDQPTPNDQKGYRALWQTIQGETKEDRQRFRKEVLQTTAADIRAFADRLEAQLGGEARRRQLEEGSLLERERVAASSLSADEALKTPSLVSVVVGSKTAFDEASRQDPAIVYKMKRVMGDGAADPEDSA

SEQ ID NO: 111 - protein, 148 aa, Neospora caninum
MADLAKRPKKRVQTFGRKKNAVAVALCTQGKGLLRVNGRPLEHLQPEALKVKVFEPLLLLGKDRFQDIDIRVRVSGGGYIAQIYAIRQAIAKAVVAFNQKYVDEATKKEVRDILVAYDRSLIVADPRRCEPKKFGGPGARARYQKSYR

SEQ ID NO: 112 - protein, 205 aa, Neospora caninum
MGISRDRRHKHRRTGGRFPVHQKKRKFELGRPPAMTKLGAKRVRPVRCRGGNMKYRALRLDTGNYSWSSQKIAKKTRLLGVVYNASNNELVRTNTLVKNSIVAIDATPFKAWFRSFYGMDLGKKKAGQEEEGSGKVSKHTLCLQSKHRQQGVPKLDPLLEEQFNTGRLLACISSRPGQSGRADGYILEGEELMFYKRKMDKKKHK

SEQ ID NO: 113 - protein, 146 aa, Neospora caninum
MVKLLKSGRVVVVLNGRYAGKKGVVVNTWEGSKERQFAFCLVAGIEKAPLKVHKKMPAKKIEKRMRVKPFLKYINVNHLMPTRYTVSSDMDVKTMVPEDAMRTVDDRKAAKKGLKKIFYEKFTNPVNDKVGKVSKDLLFLRKKLRF

SEQ ID NO: 114 - protein, 223 aa, Neospora caninum
EPHLELHCNASFFPKPGMVLSSCTCLQFFQGTKEQTKVGNRKAGESTATMSGTAAKSGAKGAEKLELQGDTWRVCNFVDKKDIIKIDAATMKQKVQIRDCKGVGIQIESKVNSVIIDNCENLRLCVNSLISGAEFVNCRKIKFQVQGTCHSIAIDKCSGVDLYVSKESKDVEITTSKSGEMNLNFPKTDQEDGDWTEVPIPEQFHHHIKNGVLETRVSELYSR

SEQ ID NO: 115 - protein, 217 aa, Neospora caninum
MSKLSTDGLKKAIGEILEGSREKKRKFVETVELQIGLKDYDTQRDKRFSGSVRLPNVPRPRMRVCVMGDAVHCEQAKELGLEFMDVEAMKKLNKNKKLVKKLARKYDAFLASQVLIPQIPRLLGPGLNKAGKFPTLITHNDKLEDKIQEIKSSIKFQLKKVLCMGVAVGNVDMTEEQLRVNLTLAINFLVSLLKKNWNNVKTLHIKSTMGKPQQIYG

SEQ ID NO: 116 - protein, 334 aa, Neospora caninum
MASLSVAAASPLAAAKSQWDARVSEPITRKPHVMPHTMSYYTKCMLGGVLSCGLTHTAVTPLDVVKCKMQVYPEKYKGLVSGMRTVVAEEGAAGLRLGWTPTLLGYSMQGLFKFGLYEYFKDTYGNLMGEEFTAKNKGAVWLAASASAEFFADIALCPMEMVKVKMQTSPAGTWPTSFSPALAKMSEMKKETKFPFGSVVPLWSRQIPYTMAKFYFFEKVVQLFYDNVFTKPKDSYSKTTQLGITFASGYLAGVICAVVSHPADTLVSVMSKAGNKGKSFGTMINEMGYCNLFTKGLGTRVLMIGTLTGLQWWIYDSFKTFMGMGTTGGGSAKK

SEQ ID NO: 117 - protein, 411 aa, Neospora caninum
MENNEDKQQQGQQAGGAAAAPAPANDEVIETNYDEVVDSFDALKLNESLLRGIYSYGFEKPSAIQQRGIKPILDRHDTIGQAQSGTGKTATFAIAALQLIDYNINNCQVLILAPTRELAQQIQKVVLALGDYLQVRCHACVGGTVVRDDIAKLKAGVHMVVGTPGRVHDMMEKRHLRVDDMKLFIMDEADEMLSRGFKSQIYDVFKKLPPDVQVALFSATMPQDILELTTKFMRDPKRILVKNDELTLEGIRQFYVAVEKEDWKLETLCDLYETLTITQAIIYCNTRRKVDFLTSKMSERDFTVSSMHGDMDQKSREMIMREFRSGSTRVLITTDLLARGIDVQQVSLVINYDLPATKENYIHRIGRSGRFGRKGVAINFVTSSDVEQLKEIEKHYNTQIEEMPMEVAEFF

SEQ ID NO: 118 - protein, 395 aa, Neospora caninum
MARLEPDTNFIFETSEDCQVLPTFDSMGFKEDLLRGIYAYGFERPSAVQQRAIVPIMKGRDVIVQSQSGTGKTCVFCLGCLQCIDPKVRDPQALILSPTRELAEQSQKVCLALGDYMSVQVHCCIGGKRVGDDIRALEAGVHIVSGTPGRVFHMIAQRHFSTRHIKLLVLDEADEMLNRGFKEQVYDIYRYLPPSTQVVLVSATLPHEVLEMTTKFMDDPFRVLVKRDELTLEGIKQFFVAVEREQWKFDTLTDLYDTLTITQAVIFCNTKAKVEWLAQKMKEANFTVSRMHGDMPQQERDEIMRQFRGGQSRVLIATDVWGRGLDVQQVSLVINYDLPNSRELYIHRIGRSGRFGRKGVAINFVKNDDIRILRDIEQYYATQIDEMPMNVADLI

SEQ ID NO: 119 - protein, 574 aa, Neospora caninum
MNASLLFRRTAPGISTASLRRRCLSTALGDTRNPLTARVCTAASGVSAPSSGVRAPAFQRTEKTFLSSAAALQPKAGPAPEYRRVPFVKEDMEKVMEEVPEFKYYYVGKENTNGNIYEGIPLDKSILEPSEIRDYVPPNSNIQYSKLDNGLRIASMDRGGLTASLGLFVHAGSRFEDVTNFGVTHMIQNLAFASTAHLSHLRTVKTIEVLGANAGCVVGREHVVYSAECLRSHMPLLVPMLTGNVLFPRFLPWELKSCKDKLIMARKRLEHMPDQMVSELLHTTAWHNNTLGNKLHCTERSLGYYNPDVIRHYMLQHFSPENMVFVGVNVNHDELCTWLMRAFVDYNAIPPTKRTVAPPVYTGGDVRLETPSPHAHIAVAFETPGGWNGGDLVAYSVLQTIIGGGGAFSTGGPGKGMYTRLYLNVLNQNEWVESAMAFNTQYTDSGIFGLYMLVDPTKSANAVKVMAEQFGKMGSVTKEELHRAKNSLKSSIFMNLECRGIVMEDVGRQLLMSNRVISPQEFCAAIDAVGEADIKRVVDAMYKKPPTVVVYGDVSTVPHYEEVRAALRAAGVGK

SEQ ID NO: 120 - protein, 311 aa, Neospora caninum
MAGSKGKSDKRKTYFSRLFALLEQYPRVLVVEADHVGSKQMADIRLALRGKAVVLMGKNTMIRTALKQKMSEMPQLEKLLPLVRLNVGFIFCIEDPAEVRKIVSANKVPAPARQGVFAPIDVFIPAGPTGMDPGSTSFFQALGIATKIVKGQIEIQTEVHLIKEGDKVTASAATLLQKLGIKPFEYGLAIQHVYDDGSVYKASVLDITDEVILDKFRTGTMNVAALSREIGMPTTASAPHSILEAFKFCTSLVLESDYTFPQMQRLKDILENPDAFVVAAAAPAAGAAAVEAPKEEEPEEEEDDMGFSLFD

SEQ ID NO: 121 - protein, 203 aa, Neospora caninum
MTFKKVVVIDCQGHLLGRLASVVAKELLKGQQIICVRCEDINISGSLHRNRLKYQRFLRLRMNSNPRRGPYHLRAPSRILWRTIRGMLRHKVERGQKALARLQVYEGVPTMVERKKRMVVPSALRIVRLKPKRNFCRLGDLSSQVGWSHGDLVARLEEKRKTRSSAYYQKKKERTKMQTEAKQFAQTTLPKDQVAFLQQYGHA

SEQ ID NO: 122 - protein, 290 aa, Neospora caninum
MVLFKDLNKSCADLLSKGYPHEKAWDLEYKYKSKNPEIVNTASVSPGGAFDASSKLKYCVSDVTTEVKMMAMGKSTIDVKYAPPTLKGLTLGAKFDRRGDKTSKDSLDILAEYKLPTIHSFFSVNPLASSFNFGNVVEYKAFRIGSEVTGKFDASAMKYAVGASYTGLASKAGEFTVSVKTAPSGDAVFGRMIGSVHGKTTDNKSAELAAEVDCNLLDGRTNIQFGGLWYLNDQKDTFLKAKLTQNARVSVALTHKVCDYVSATIGSQIDVSKPSNPDAVKHGLKLEICA

SEQ ID NO: 123 - protein, 235 aa, Neospora caninum
MASTGNTCKKRKFVKDGVFQAELNEFLSCTLSEDGYSGVEVRVTPIRTEIIIRATRTREVLGDKGRRIRELTSVVQKRFGFAPDSVELFAERVENRGLCAMAQAESLRYKLLKGLAVRRACYGVLRHIMESGAKGCEVVVSGKLRAQRAKSMKFKDGYLISTGEPSKMFVDQAIRSVQLRQGVLGVRVKIMLPHDPEGKRGPATPLPDTIIVMDPKPEIPVVQPEEMDEGALGPM

SEQ ID NO: 124 - protein, 438 aa, Neospora caninum
MAGSAVRMCVFSVALALCLALGVPPLPSSSPSVLSPLACVLLAEAAEAQAPAEKPKAAPKKTDSASESREARLLKYAEQRAENAEAELKKFRETHETSVRACTEATQRKQKAVEACEKQAESLRTMYNASQTAKADAEKKLRELEVKHAAATRAEGSSEKLERENASLQQQLKQKEQETAEARSRVRALESEVAKLAAAKASLAAKARDAEAPKSSHIFTIQAMQETLGAIGHLYMAIAEHLVACVPQEMFDKFTTLKLEVATLAAPYVEMVNSKVYQPVAPALAKAQTFFETTLYPIAASGAAKGVRMVASLSDDLLPSVNARVDAALAPIFASHPRVEALVPPSIADRVALLLFLTVVTYFCALFAFRLLLCPVFACVCPCCCKRRHKKGKHSKKFTPAHGASLHASLQKDKKGLPPQESPTRPFAFAGDYKKHKA

SEQ ID NO: 125 - protein, 955 aa, Neospora caninum
MRQFTLSLLVLLPLLQRPESVEHAVQSTLSASSASLFPSSLAAEATRARHRASTLEAEDGASAGDDEDAVLTEQDQESEDECAAQEVMQKMLQDELNGSNTSLMAASPQWKLLKSNLEQHMDNKEMCAPLSGSQPVCRQIQKSDDGEVLGSATTQLKCGGAEYEKLIEKYVHEKNCLTAVAFSHALAQSWLGHLDPSKASGGSEVARKGIVEALVSHYHKAMDAGFLDDTLWYIYQDAAALLEAFKTAATDGLNAFNSEDVRKALLRRRETQTAIFCSVGNGNDAQLGSNVIVNEGTVIFRVNLDGEDMSAVEAFKQAVDTFAKKFVQAVLEEGGLLDRAIELHKKFYKFRFFKIQGLMQSAEPSADVREQNKLLAALPLEKHKTKEKHPESSFLQVGAGVQDEPQQLLAPVAPTVASVATGVPAQNPAAAVAMPIAPAQVAGPTGAAAAVQADPYLSAVPAASLPLSQAPVPDLQPVVASLGAQGGVQPAQPMPTFQMPAQIPSPPVQAPAASPVALPAQPDAGAPGQAAVAQPSPAAPGQAAVAQPSPAAPGQAAVAQPSPAAPGQAAVFPGAEPTQVASGAPGANLAGVGQSRQVMPPLSPLEVYEQGAQRQPSGEGQQQVAPDTVKIIQEKPSTPEEAAREHESRPQPKESEPRHRGALGALGERGHLPEMPYNTAQIPSKEVKAVPIKQKVMAVMSRLRMLQMHNDTVAFEVDSAGVEKIVKAAYLDVTDRVFGVWGGLLPQAAVTTTAQLLTLLLPKPDVDVAEFYNKTMNSEGAISDGVQDQLPVNHTRLVERFAIFVEEMYRDCWRKFFNTNDNFLAPANDAETDAQDISSATSIPEVSAVQLNAGKVVDLLANGVVERGLDHAASMEAVVKEHSFVSTASAAGERGIDMAIVDSSDGIGVADLAKVFTDEQAVRGLTEKALSSSASTVVASTSLIALAVLTVGASS

SEQ ID NO: 126 - protein, 695 aa, Neospora caninum
MGLLEMSRVVGLLVLFCLLGLEAVEKKLHNVSAENPPEGNVGAEQARNGGDPTTVVRVAIVGGGITGAATSAFLKVLEQRILSEFRGKGLWKPGTEDGPAKPFKIEIDVFESNNRLGGRLDYAVVNGQAVDIGGSDIEESNIWLSTFHNMLNRHISEQQKAASDGLDGSGGAERPVPLGAFESSDSRTLLIMHGNRVLDVSHPGIFLALRGNGTGLLNFMRKLREKWRSVYSKLAGMPLCVYVTRDLLLQPNFEKENGHKYEELCVTPKGFASGLDMLDSAGLKPLVQETFASRVASIGLTAEGMDFVSGVTRAIYSQDSVDINSVAGAVAMLGGIGTLFQEKRYSGRVLVEYLINRFASNTFLDCAVSQVVEAKDPPAKRVTKSGKQYTLSPRRESCDTDARKRMDSVRYDFVVVAAPLELSGVKVYRRREEVSRESASTGALEPIPVLPKSWRTVHLAYLVADAIRWTRSPYAVEDRNKSTGVSRLVLKAQPKGTVASNTPDFYVAGCWGHAVEHGDLNARRKKMSANKIGMSIDIPEREMHSAAQESGDESPGKQTWCRVASPQRLTEETLRSTFVNPQHIFRHVWMGAYPLIVPFDIESTSVAADAFTSASSSAQAFIRDVPPSKHTSGDGTGRPRSVPAQSNFVLTDNVLYPSAFESIFSCMEGQAVSAQNTVNLIGSALDILPGDVDTP

SEQ ID NO: 127 - protein, 2230 aa, Neospora caninum
MAEEFERFKRFEYRQNSNLVLQRDTSTGVAPAVNLGEPTGEPESLAGRKLYPMGDKVERGLKKEDRPAKSADPKRAKLKRNKLDLKRGATVLDADVTEIFFYKPTTQQTRLVYEQLLVTLQQQLGDQPDEVLKGAADEVLAALKVDGCKDSERKKNVEQVLGPLTSDRYTRLHQLAKNITDYSLGGEEEDGAQAGGLDGSTGVAVVFDEEEEEDGDGNELMEVEVLEGEEEDDEDEEEAEDKERTYLAAKNVDDDEFEDRDAYELDISKIDPHWLQRELNNVFKDPNKAVATEKEILSILATPDIQKCENQLVVILKYENFELAKLILKNRWKVFYAVRLGQAQSKEEKNAIFEEMKNSPEGQEVLELLDSLSSRRNKEKEIAINVRKEAASLAAKAQARAASLRAAEFAEEDAGGGAGLHASSTAAFAGKPGKALGAALSKARDLDEATGDRDGLEAAGAHPHAMKGAVAKKPTAAVDLSSIAFHQGGHFMANTRVKLPDGAQRIETKNYDEVVVQAFKKPQEAPDARLPISALPDWAQSAFSCVNIEQLNPMQSKVYKVAFEEFNENLLLCAPTGAGKTNVAMLAILNVLGRHRNAKTGHIDLSGFKVIYISPMKALVAEQVQAFSQRLQPYGVTVRELTGDVNLTRQQIEETQVIVTTPEKWDIITRKAGERAYTQLVRLVIIDEIHLLHDSRGPVLEAIIARTIRQIETAQEHIRLVGLSATLPNYDDVAVCLRVTPEKGLFFFGNHYRPVPLKQTYIGVKDKKAIKRYNTMNEVTYEKLMENAGKSQVLIFVHSRKETVKTARFIRDMALQKDTLPRFLQHMTASREILQSEAEAVKTGDLKELLPYGFAVHHAGLPRTDRKLVEDLFADRHIQVLISTATLAWGVNLPAHTVIIKGTQVYLPEKGSWAELSPMDVLQMMGRAGRPQYDTSGHAILITQHSELQYYLSLNNQQLPIESQMISCLPDMLNAEVVLGSVRSREDAVNWLGYTYLYVRMLKNPTLYGIPPEEIERDKLLEQHCVNLIDSALKILDKNFLIKYDRRMGAIQVTAMGRVASHYYIKYPTIAVYNQHMKPTLSDIELLRLFSLSSEFKYMPVREEEKVELQRLMERVPIPVKGSPDETSSKVNVLLQAYISKLKLEGLAMMADMVYVQQSANRIMRAIFEICLRRGWAMLALRALQFCKEIDRRMWSSMTPLRQFKVLPEELLRKIEKKDLPFERYYDLSSTEIGELVRVPKMGKLLHRLIHQFPKLELAAFVQPLTRTCLVVELTITPDFQWDSKVHGSGEVFWVLVEDVDGEQILHHEMFIMPPFTGEVEHTLCFTLPITDPLPPNYSIRVVSDRWLHSQSSLPISFKTLILPERTPPHTELLDLQPLPISALRDAKMEQVYAGSFKAFNPIQTQVFSTLYATNENVLLCLPPTSGKEICLEFAILRMLKTEPASQWKAVYIAPHPLVVKERLDDWVTKLGRGLGVKLAELTGEMQQDMKLLEQSQLVLATPEKWDFVSRRWKTRKVLQSIRLLLVDDLHLLNSPVGSTLEICLSRTRYISAQLQRPIRIVAMANSLANAKDVGDWLGVSSSGLFNFHPSVRTVPLEISLHGFDVYHREARLLAMSKAVYQAVKLYTSNREDERSGSLSSRKLKNVIVFCSDRRHCRLTAIDLLLQAAADDDPKKFLHVSDEVMSKYTSVVRDKMLNETLSYGVGLLHSGLSAAEQQLVQQLHAAGAIQVVVVAEECAWGLQMYAHLVVIVDTKKFTENGYEDYTVADVLQMLGHATRSSIDKHGYAVLFCPSSKREFYKKFIFEPLPVESQLEQNLVDHINAEVVLKTIENKQDAVDWLTWTFLYRRLAKNPNYYGLQGVTHQHLSDYLSELVESGVHTLEQAQCVSEQNDVDLQPLNLGLVAAFYYVKVDTIELFNRSLTPTCKRRALLEILAASSEFSSLPLRPGEEGTLKGLAQRLGVRLPSNSEDLNKPSTKALILLYAHFNRTPLPSDLIADQKILLEPTIRLLHALVDVISSNGWLVPALSAMEICQAVVQAMTTTALGGGNATQCSPLKQLPHFTDELVEKAKEMGVDDIFDLMNMEEKDREKLLKSLTPSQLKDVAKASNRYPVINVEYQVSKKDGVLPSENLQCTVTLERDCAEETSSAVFAPYFPREKEEQWWLVIGQASSNSLAAIKRLSLNKATTTVTLSFEAPETDGKHTYVLYLMGDSYVGGDQEYKFDVRVRS

SEQ ID NO: 128 - protein, 477 aa, Neospora caninum
MAEQSKVKDLTLSAFGRKEIELAEGEMPGLMALREEFGASQPLKGAKISGSLHMTVQTAVLIETLKALGAELRWCSCNIFSTQDHAAAAIVKSNSASVFAWKGETLEEYWWCTVMALTWPDAAGPDLLVDDGGDATLLIHEGVKAEKEFARSGALPDPASTDNAEMKVVFKLLADGIQKEPQKWTRLAANLKGVSEETTTGVHRLLLMAKKKELLFPAINVNDCVTKSKFDNVYGCRHSLPDGIMRATDVMLGGKRVVICGFGDVGKGCAAAMKGAGARVVVTEVDPICALQAAMEGYSVVTLESQLAVGDIFISATGNKDIITAKHMSQMKNNAIVGNIGHFDNEVDMAGLTSWPGIKKINIKPQVDRFVFPEDDHGVIVLAEGRLLNLGCATGHPSFVMSCSFTNQTLAQIDLWDNVATKRYQNDVYLLPKELDEKVARLHLRSLGCELTTLSQEQAAYIGIKPEGPYKSASYRY

SEQ ID NO: 129 - protein, 244 aa, Neospora caninum
MQLTWKQILLIAGGTAAAGACLYYLLREDGSEAKEADGEPKKITGEATKEQVITILRGILKSQEKTKALMKEFIKDILNEDLAFEQAYERVLQKHPDDPLEQYGLTMPDFDNLLDKYQHDPQIKDLIVRIMSSSAPSEPNPRGQTIDKAKVIQVHEYMKQELQKLVDYIQKSPSRSELDVKNVTLTAQAFVGAKVQKKFGLTSEDVESAVIYNHKELAVDPDFVRVNIAIQTIMNQLIVPQFAM

SEQ ID NO: 130 - protein, 505 aa, Neospora caninum
MAIATLFPKEEGAGFSLTTQSHGECKVRVDLPSSISHPDWEKIFNSRMFQDWLSVYATADRLRLVRVSLESTQHGKSAREDTLTSLTMHVDAADKDGDVYSGPVYLRPQRRAVLVLLRNTETRTDMCLFVRKPNLSVGLADTLELPEGDFEAETGKFVGPAAEELERQLDAPIYEKHLVNLTQVTFGGGGLALGGDLSASLASEGKAPKNANANEKDEKGVRIPVAMTGGDRVELYLYRANVSPETMAGIESRIGRVRRRGKNAANAGSEVVPATKTAHSEGVKLSLVQLGDAWGLAADAPAVSALFLVHELRYHRLMPKYRNPLEGAEAEAKSPRPVQKAVATFKSIQDLEPTSKGLNLRVKVVSPKVVDRDRTFPSGRTSREGHMVVGDDGAVITLKLVDQQMELPDAEGTPLLIRNGLISMEEGHMKLVVDRWGKIISEIPEAEKDSFKFTVNGARDMSATEYELVVLKDGDEGDNGAVSGGRGRGGRGRGRGRRGMGRGRR

SEQ ID NO: 131 - protein, 573 aa, Neospora caninum
MAPRGEGSAPEADAEMGIIYKVSGPPGLCVGDPVVKTGKPLSVELGPGLLDNIFDGIQRPLERIAQVAQSVFVPKGVDVPALDHKKLWEYKPVSNVQVGDILTGGDVIGTVQENNLFLEHRIMIPPKVQGKVSWIAPAGSYTVKDTVMTLEFRGEQIPIQMSHDWPVREPRPCLEKLSGNTPLLTGQRVLDSLFPTVQGGTCAIPGAFGCGKTCISQALSKYSNSQVIIYVGCGERGNEMAEVLTEFPELTTVVNGKEEGIMQRTCLVANTSNMPVAAREASIYTGITLGEYFRDMGYHVAMMADSTSRWAEALREISGRLAEMPADSGYPAYLGARLASFYERASRVRCVGSPEREGSVTIVGAVSPPGGDFSDPVTTSTMSIVQVFWGLDKKLAQRKHFPSVNWTTSFSKYIRALEPFFDSYDSEFSSLRQKVSDILQQEAELTDIVQLVGKDSLSEDQKLILEVARIIREDFLQQNAFSDYDYMCPLYKTVGMMRTICHFYDQCLRVMQETSGSEHKIGWGTIYNTMRPTISKITSMKFLPPTTTEAAAKQHFKQLSDEITSGLRGLVEK

SEQ ID NO: 132 - protein, 578 aa, Neospora caninum
MYAGYGSSSGGGYGGGSNSTYGYGGGYASSYGGDSYGGGGYGGSSYGGGMYGGRPGGGMGMGGYGADALGSKLQRVDWKAVDLVPFEKNFYVEHPAVASMSTEEADRIRRANEITIVHGHNVPKPVPTFEYTSFPSYILDVINQTGFQKPTAIQVQGWPIALSGRDMIGIAETGSGKTLAFLLPAIVHINAQPYLSKGDGPIVLILAPTRELVEQIRTQCRTFAASSKIHHAVAYGGVPKRPQIMELERGAEICVACPGRLIDFLESRVTNLRRVTYLVMDEADRMLDMGFEPQIRKIVSQIRPDRQTLMWSATWPKEVQNLARDLCKEEPVHINVGSLDLQACQNIKQEVMVVQAPTSRQETRKVPRRVEKCADEEEFGDSCGVEYEKRGQLMSLLRRIMDGSKILIFAETKRGADNLTRDMRVEGWPALSLHGDKKQEERTWVLDEFKNGRNPIMVATDVASRGLDVKDIRHVINYDMPNQIEDYIHRIGRTGRAGAKGCAYTFFTPDKSRLARELVRVLRGANQPVPPELESLGMYSSSSSGRRWGGGGRGGRGGMRSGGFGGGPNALPLGSRPY

SEQ ID NO: 133 - protein, 404 aa, Neospora caninum
MADATGSEVEAEVVQDLSNPDVVTKYRTAADIVNGALKKVISGCIPGADVYALCKTGDAYISEACAKVYNKKENGKKMEKGIAFPTCISINEICGHFSPVEENAETDRVLTEGDVVKIDMGCHIDGYISVVAYTVVCDAALPGIFEGTPGAQQGRISGRKADVIKACWTAAEACMRLVKAGHKSTDLTKTIELAAKQYGCTPLQGVLSHQLKRYVIEGSKCFAGATPGPGEDEPEEFEFEPNEVYGVDIVISSGEGKARDAAIKPTVYKRAVDRTYILKSQLGRHFMSEVQNKYPTLPFSLRGFSDDRACKVGVAEAMRHELLHPYPVMTEKPGEFVAQFKFTLLLLPTGTKKVTGLPLLYEKELDSSHTVEDESLKALLAVSVNPKKLKKKAQVEKKEDGGNA

SEQ ID NO: 134 - protein, 556 aa, Neospora caninum
MIRPQGPVLVLKQNTKREQGRKAQLANIQASKAIADIVRTTLGPSSMLKMLLDPLGGIVLTNDGNAILREVDVLHPAAKTMIELSRTQDEEVGDGSTSVVVLAGEVLAGAVDLLEKQQLHPSVISHGYVMALEDTLKYMNEIAIDVDVSDDAKLRHVVDACLNTKFSSRWEGRISQMAIDAVRKVEVKLPNGKKEIDIKRYAKVEKIPGGDLEESRVLDGVMVNKDVTHAKMRRYIANPKVLLLDCPLEYKKGESQTYVEITKEDEWAKLLEQEEKEVRAMCDDIIASGCNLVITEKGVSDLAQHFLVKAGISCIRRVRKTDNNRIARVTGATIVNRTEEITKEDVGTKCGLFEIKKIGDEYFTFLTQCQEKGACTILLRGGSKDVLNEVERNLQDAMNVARNIMLEGKLLPGGGATEMAISARLLANAKNVESVKQYPYKAVASALEVIPRTLAQNCGTNVVKVMTELRAKHATCSGDSAKWGVDGETGAVVDMIEKHVWDSLAVKQQIVKTAIEAAAMLLRIDDVLSGVRKEGTGAPGDNMEADPETFGDSRDG

SEQ ID NO: 135 - protein, 728 aa, Neospora caninum
MGKDERRREFGEIDWKRVYFFLVDERYVPPTHPDSNQLKIRQHLLGQPPGVACNQAGGECPDDVLPVPEENLIVPDTTLPLEECIVKYRSALLDLLAATQQIDFVTLGLGPDGHIASIFPPLSEDSLKAQMDPNAIVLHTTTNQFAGFDRITVSLQLLCGAHQKVFFLKGDDKIRLWREMQDDSHPKAVTDLPALAVIQSGNVKVVATPPLDVHEEHLQQQLRADRTFLSVVVLGASGDLAHKKTYPALFSLFCEGLLPPNFHIVGYARSKLSFDQFWEKISQKLKSLSSFFCRRSSSGDLLSKFKSHCSYLAGMYDRPSDFDNLGKHLQEAEGDAQQVGRVLYLALPPEVFLPSVKSYRQACWNEKGWNRVVVEKPFGRDLKSSDKLSASLMALLKEREIFRIDHYLGKEMSLSLTALRFANVAFMPLFHRDYVHSVRITFKEDGGTWGRGGYFDNYGIIRDVMQNHMVQLLTLVAMERPASLKDDDIRDEKVKVLKQMPPVKISETVLGQFTKSEDGKMLGYTDDETVPKDSKTPTFCTCVLWINNERWSGVPFIFKAGKALESKTTEVRVQLREAPAGASFFGEPNLTPNELVILVQPHEAVYLKIHTKKPGLLSSGLQPTELDLSVMDRFDVDRLPDAYERLLLDVIRGDKQNFVRTDELREAWRIFTPLLHEIEEKHIEPLPYPAGSSGPQASYDLIQKYYSYKRSSYRWSPPKREASSEASH

SEQ ID NO: 136 - protein, 376 aa, Neospora caninum
MRGVFAILGALVLSLFFAPTEIRALFKRRETQAPKLGHADLLENNGSDTMSLKATEWYMKTAVAMIKGARPYLEDTCVLTAAVPGAPNARIQAVFDGHGGAFAAQFLATHLQEVLTTIVIIERLTHPEEVIVQGREIIPSTLTAFKTIHELDTPLGKILPRQKIVIGNKRWPFKLHVVNVGDSRALLLNQRLYAPLTRDHRPDDPAEQARIEAAGAEVKMDRGTPRVRGLAMSRSFGDSDRKRGPGPHPITAKPDIRQFFASANDVLLLHTDGLDFGGADWDLVADEVRESLRRSDGIRNMVTRLVMDAHRGGSKDNITALMTFFSKHLQEQPTAKLRILRKRQKNNRSKKLLPLEEDWTDKLLHGPAGGFSLPMF

SEQ ID NO: 137 - protein, 205 aa, Neospora caninum
MGAYKYLEELWKKKQSDVLRFLLRVRTWEYRQLPAVHRCTQSTRPDKARRLGYKKKQGFVIYRVRVRRGDRKKQVHKGIVYGKPKNQGVRKQKSSRNLRAVAEEKVGRKICGGLRVLNSYWVGQDAVYKYYEVILVDPAHNAIRNDPRINWLCKPVMKHRECRGLTSAGKKYRGLRTKGSGAARLRPSRRACWKKRQALRLRRYR

SEQ ID NO: 138 - protein, 330 aa, Neospora caninum
MGAVCGRPKKGVASKDPQAANDSQTAVQKQQTAVGANAGAGTAEAGAKVSPHPAVAAQSSLPVTRNAARIDEFKPGDGDGVYLLEATEGHVSLVSQYAHDKPTDQGIVLLQVKAPPYRPIPESRFVLQSGKRILRQNIDMMKDTTEAKTKYCEVVMEFIRLAATYNGFLWASTHLGEIKQPFSIFYLESRQKAAPEPEAPVAEIKNTLPIGKDALEKKKAATGENDTKKEGEQNESGENDTKKEGEQGAPGNAPAAESEQAPKTKNEIVVKFLGPECSVSHRLLATCGILPLSLDKAKELIPEDKQVNNVDEIKTIVTEAGGFFVSPAAA

SEQ ID NO: 139 - protein, 257 aa, Neospora caninum
MAAPSGKREGVDLENVATVELLEELKRRYACLAKPEGRYIFIGAPGSGKGTQSMKLKKSHCLCHLSTGDMLRHAVATGTEYGKQAKAKLDAGELVSDDIVLGLIDEKLKTPECRRGFILDGFPRNTSQATGLDNLLKQKNQKLDGVLYFDVPDNVLVERVSGRRIHLPSGRVYHVSYHPPKVAGLDDVTGEPLHHRKDDNEVTLKKRLDVFHKETVPVIEHYAKMGLLYKMDAAKDSTAVTKEMYDFVSKHHKSFFG

SEQ ID NO: 140 - protein, 353 aa, Neospora caninum
MTGRNSKGPQKLPSQDGSDYGYPQKPQKYMPTKAELMDPDYSSCCKGHDTQKDGAYGSEQFAKQEAQKYDSAASVGQTIQRGRERTVVERPLHPVAAGDVPARRLHLSDLDEAHRCHSPSRQPGYCVEELCTCGMHKCIPSRAPLPFVGNTQYRQEFGPKPLPPATAATQVTLPPTLPFEAESSYRTEFVAKPLPPPVKFAEAKLPPPLPFEGESAYRADYRPKPLPQVPKPSEVKLPQSLPFEAQSCYRSEYVAKPLPPPVQASEVKLPPSLPFEGSTQYRDEFGPKPLPPVAKAAEVHLPPALPFEATSMYRSEYVAKSNPICPVAKLPQYPAATYPQNHVFWDPATKQWY

SEQ ID NO: 141 - protein, 268 aa, Neospora caninum
MAERGSFGRGFGRGGGRGRGRGRGRGRGGAEDDLKDWVPITKLGRLVRDGKISSIEEIYLFSLPIKEYQIIDHFFQPGNCAAPLKDDVMKIMPVQKQTRAGQRTRFKAFVAVGDSNGHCGLGVKCAKEVATAIRGAIIAAKLSLVPVRRGYWGNKIGEPHTVPMKVSGRCGSVRVRLIPAPRGTHIVGAPTTKKILGFAGIKDCFSNSKGSTKTRGNFMKALFDALSQTYGYLTPELWAPTVYTKSPYQEWSDYLARTSKDALSRPLA

SEQ ID NO: 142 - protein, 312 aa, Neospora caninum
MASSSATSSSSPSTVSPTAVAAAGKKKPEPKTPLEIIIYSRDQAFRGGIAGASAQVVNVLAFMWLRTTMNYQYRYGGTTFGSIKKLYHEGGVRRFYCGLFPALMQSPLSRFGDTAANVGVLAALDASPRTQDLPIGIKTALASCGAAGWRFFLMPIDAWKTTKQVEGGSGLKVLINKVRTHGIPKLYHGSLAAMGATWVGHYPWFFTHNYLSETVPKFEFAYGNHVRYALIGFASSVVSDTCSNSIRVVKTTKQTSVIPLTYMQTLREVLSKDGLTGLFFRGLGTRILTNGLQGMVFSVGWKAIQDQLNKKN

SEQ ID NO: 143 - protein, 376 aa, Neospora caninum
METKISCKKGGDHSSLSLRLPLLALGLSLLAPAAVSARLVSSPPADLAWFAASSSPLPTASLGFLAASPARVFSRSIYPHCDGGARCASDAFRASSPSVRGAAADPGVASTTSCSAYKLTFGGPEAGETEGRVALVTGASRGIGKAIADTLAEAGVSHLLCVARQQAACDEAAADLRSRGFSASGHAVDVGDGQAVSALCEDLLKQYPHIDILVNNAGITRDNLFIRMSDQEWHDVINTNLNSAFYFSSHIIKRMVKNRFGRIINISSVIGVGGNPGQANYAASKAGMIGLTRTLGKEYANRNITVNAIAPGFIRSAMTDKMPEAAKKQALSQIPANRLGEPKDVAALAAFLASDQAGYITGKVIPVDGGMLFGGN

SEQ ID NO: 144 - protein, 398 aa, Neospora caninum
MASNSETLQQILGDFSKQASEYLKENNALERLGLSHFQENLERVTTLIGVKPNLRKTITLNRRSLDVLYLPIYTFSQQRAVERNAEADDNAISVVLQDPHMARFIAKYVDMEPSRTMSTAPKHIDSFLQQIQEVQRYVLSEGPIVFSLVSRLDAVVSAFLQYTQAMFSSIARYLSLTDRFAKNKRALFFFGKYTLPKLLKVLFIINDIEAQLLRRSEMLESPEDAKHLRQQLRVLVKKSSETVGSLHDLSKGCLIGCSAAFQIEYAVCLKNYEEGERADIAFHPFASTPPLEGMTLPSSAAALGEANAASSTEALDASQYLKVVHDQAQAEQQRKRREHVSKVAGGVLGVDPEGAALGAGLGLEEESTSGVTATTTSTQAPEDGESDRDAALDLLNSY

SEQ ID NO: 145 - protein, 557 aa, Neospora caninum
MSPCTFLLVFLLFSCVTGLGRAYSAQRSIEYHNGVTKRRLPQSVGIEKNTGVQYKNVSFSARATGPFAAQQSQTGPNFVQLTSTSQVPRRRRRQQERNVNSEESPRGSGSRRRGPFSLQPWLRGAANLFGPRRRPERPEIVHTARLQQIELPPSIASIATLLQQLKADIEKFSRYQRNKPQLERAVKAEFFRLGTTKTLVSKACGLPRTIKFEAIISSGTWSTVWRVTDTREKMQYALKIRRLRGALSGEAGYTSILKEGQSVTEASPAYTFESLKQMIALDILRLEGVPHFVKETDSRYTIANLFLLMPLAKTDLLSFLQALFSRPPISESPSGFQARLKITAEAVTIVANFQKPGVVHGDIQPQKMLIMPNGSVVLGGPLDIHYPGTRRSPDVFTVPYLPPELLDEEGVYSYLTDSWQLGLTLYQIWCLRLPFGLMTPVVADDPDYYIVEEVLRKPDAELSFEQAGCVANIPEYVESLIKQLLQFNPENRLTPARILVSRDFNRLRAHVDRLERSAREPVDSPPPQDLRRIGWGLSGLQDGTELQSNNTNLESQN

SEQ ID NO: 146 - protein, 620 aa, Neospora caninum
MDEQQIERNAGEHAEKEKDAQRAAALLEVEVVQGRDGEQSTTEARLLPQLKTNGQPKRTLVGSQEKTEQKSDGTKEKNMQKRRKVPPSTVAVAQVRSTMKQIAVSRFLASAWRQSAGSPVLPFQKNGTLALFSAASQAPLASQRRGFGTSGGKYDVVVVGGGPGGYVAAIKAAQLGLKTACVEKRGTLGGTCLNVGCIPSKAVLNISNKYVDARDHFEKLGIKIDGLSVDVGKMQKQKQKVVSTLTQGIEHLFRRNGVDYYVGEGKLDGSNAVVVTPNDKSEKRTLDAGHIILATGSEASPLPGNVVPIDEKVIIRALALESVPKRMAVIGGGVIGLELGSVWRNLGAEVTVVEFLDRLLPPVDGEVAKAFQKEMEKTGIKFQLGTKVVGADVRESSATLHVEPAKGGNPFDMEADVVLVAVGRRPYTKNLGLEELGIETDRVGRVVVDDHFCVPNYPNIRAIGDIIRGPMLAHKAEEEGIACVEMIAGVGEGHVNYDTIPSVIYTHPEIAGVGKTEEELKASGVPYNKGAFPFAANSRARANDVATGFVKVLAHKESDKILGAWIMGPEAGELIGQLVLGMEYGAAAEDLGRTCVSHPTLSEAVKEACMACYDKPIHMA

SEQ ID NO: 147 - protein, 436 aa, Neospora caninum
MFSECCQPCAPCEGEQGSGAALQAQQTQGSRLVSGVVATQGEARILEPLVQERVVEVLKEEIQERVIEVPQVQYVDRIVEVPQHVVHEKVTHVAKPIIQERVRHVNKPVYQQKIIEVPQVKVVDKIVEVPQYVYQEKIIEVPRVVVQERVIPVPRKVVKEKIVEISQVDYRDVVIEKPLEAVQVIQEEEVVEVPKPVVMEKVVDVEKVVEVPHIQHTYRNVMTPQYRHIPKPVEVPMTHYRPIPVEKIVDRNVPVPVELQIVQEYLCPKIEPRYKEVPVPVHVQRTIEHPVPKEAMGNPKLLPLYYQGSQEGVEGIVTPGHPCYSLSACCMPRREQQPVEGWDGGAPPAGWAGWSKDHIPTSLRSDQHPSGAITPVSAGGAVGSAPPSPAPNAEAIQAQQAAMAQASQHPAGGEGPYVQVSVTPLAPGQQSQVNIN

SEQ ID NO: 148 - protein, 212 aa, Neospora caninum
MVSKNNVLPNVHLHKWWQRYVKTWFNQPGRKQSRRLRRQEKAAKLGVVPSGLLRPVVRPPTQRYNLKVRAGRGFTLEELKAVGLSPRVALSIGVAVDHRRRNRSAESLNANVTRLKAYLAKLVLFQRGSKAKKGLAGIPADTPKSQIQNVKHVKISTAMPIPKASKRCKPRAITAEEQKFMAYATLRKALRDCKNVGKHEKKLAAEREANQK

SEQ ID NO: 149 - protein, 569 aa, Neospora caninum
MICSIMGSWRRERPARPSDQQWITEWRQIGIVGVAILLVLVAESSLLATGINPKTRSGGSQTLSASTPQNPFQTPELKAFLERYNVTLHHQSGVNVDLGQDKEVDGKLYREAAGLCPVWGKYIQLHQPNRPPYKNNFLEDIPTEAEYQKSGNPLPGGFNMNFVTPAGQRISPYPMELLEKSSKIKASTELGKCAEFAYKTTAMDKSNQATQYRYPFVYDSKRRLCYILSVSMQRMEGSKYCSTNDDPVNLTWYCFEPQKSPTANHNLIFGSAYVGKDPDAFLTKCPNQALKGYRFGHWTNGRCHDYTELADSWIEAVDSKAQCWVKTFTNDEVASDQPRTYPLTSQHSWNDWWPVHEKDQPHSGGDGRNYGFFYFDSNGKGKCALSHKAPDCLVSDSKAVSYTALGSLSEETPDIIIPSNPSVNPSTPDEALQCRSSEFPETFGSCDVQACKRQKTSCVGGQIQSTSVDCTAEEQNDCGSNTALIAGMAIGGVLIMGLLAGSGYYYSKRLNTNQGVPAVDHDHEFQTQRNAQKKRPSDLMQEAEPSFWDEAEENIDQSGETQVLVEGDY

SEQ ID NO: 150 - protein, 1341 aa, Neospora caninum
MAAPAPDNDVPSSAGQDPTPTGSAAVPEVSAGGNEHSKSADGAVREDTQAGSAVAEGTAAGQDGDSPHREFHHHRTVSRRLSSKRDSASAPNGAGHMHLGKSISSVSQCHREEHARLLPVGSSMSLAPGMGYENVETEVIDRLSKSHVSLKELVETARKTDPEAFRMAVTLTEQSHPTSGKNRFASLSIEELAKEFGLKDLNNGLTEEQVQENRRIYGPNILEKDKSEPVWKIFIQQFLSPVVLLLLIASIASLALQEWVEGAAILIIVTLNASLATYMEKSASNALAKLASMAAPGCVVVREGKVQTVGAVDVVPGDVVVLATGNSVAADMRCIESVELKTNEALLTGESEDISKTLRAKDYDTPFATNLCFASTIVTNGSGRGLVFATGMETQVGRIAQQLKKAGEGSRLTPLQRGLNRLGGMIGLIAICVLIVVVVVAILTGYKDPAHPDADPVFTIVLVAVGFAVSSIPEGLPMVVTICLSLGARDMVKRKANVRKLPAVETLGCCSVICSDKTGTLTEGKMTAVRLVTVCRQGKVVNADGFTKSFGFYPTKGFDPNGGIFDLNKLDEKTKNNLMIQYRDGAFQDYDAICHNYGNPANKDPTTKLVRSVMLSGYLNSHATTLERDPDTNRWLAKGNMSEGAIVVGAAKARFGSPLAGKSERAGMHDAKLDYPRVADLEVPFNSSRKMMMTVHQLPSANFFGDICLNSDGNKYTHCAIVKGAPDRVLQHVRYTVREGLSGPSVDWDTPVTPEEIQSVEAVNLDLSQQALRVLALTFRPLTDADVAALRKQDGADLRLRFALGETREELCLLGVIGSVDPPRPGVREAIERCGEAGIRVIMITGDQRPTAVAIAKDIGLLTSHDDSEQASIQCSGLHIDDDPMNEHLPEAQLDEIIARVKVFSRAQPEDKIAIVEALKRQGHTVAMTGDGVNDAPALKAADIGVAMGIAGTDVAKGASEMVLLDDNFVTIVAAVEEGRKIYSNIQKFVCFLLGTNIGEIIYLTIAIAASMPLPLEALQVLFLNLMSDGCPAVALAKEPSDDENMKIPPRPRKQPIMTRDWWLYGNLPHTVFEAGCVLMSLALGLYLCTGVVQLTPLHDQCSYYTAIDVSNNKEIDYRYFCRSFEYRVTQDYTGWVTHIDFWNPETQTMEQVLGAIAGKHPDVTVRTPGLAEYITEAMSDGCPSDVATDPKTGFCMPAAGTTVSSSSETPKGAAPRDYFDVSARGAKMGRTCSFITAVWCEMLRAYTVRSWHWFFLVFNRNPWMHLACSISATLTSLLTIVPGIQSAFSTCALPWYLYLFAIGCGFVNLILDELIPKPLYRWKNARETRAALASKASAVA

SEQ ID NO: 151 - protein, 1794 aa, Neospora caninum
MGSGPSRGRVFLTFWFLKLFPAPLLLTWWQLTCSLLCAFVLGEFGDAFHNFRYFPRLRWPDFQALLGYLPYSVSYCLFVLFSNVLVAHLPNPLYLPVVSAVAVGTTQLFYFFGCSSAHWPSPLRCVSTCLLVGPSLLCCAVCGSTFFFYALLSTLATVLFRACFLPKALHTPCGHGAELNFYQNLSGALLLLPSLVAGGLPPTLSFSPFSLEWRNWQLAGCWITVAFLSFLRNVVGNRLMRDGGADVWRAAEILALLLVGAASCWLLPFPGFAVAATYAFVLAGRLLGGLDSLADEERRGQLRRALIRESPDAHDSKNLTDEPVLFVHADGPATSFAQGSPSDIWPDDEDKEVFAERRAQLMDIVHAYVTRLHHEDLDLIDEMGGIRAISQSVGSDVGEGLPILKRHDSSLRGSFDSERSGREGSVRRGESAVSRTLGVLHSLGSASGLVLGHHGERRREGSEEDGPLIGGLTSRQWWIGRLLRRSTGSEHDDLVRTQQRRYGVNRIPHRPLTSFWTLLIEAASDATLRVLMFCGLLSVILALLFSQEPEVEILEGVAIWVAVLVVVVVTAGNDWMKEQQFAQLSVVKDDKKCTVIRSGQKEQISVFQLVVGDLLHLEAGDEIPADALVVQARDLTVDESSLTGESDMIRKAPFQQCLSEVGAQEAVSPRARDSQDFSAAGDDLLERVKEPEHEAEASTQADNTVPPCSLPLTHPMSTASGVSDGPKAEGALYVQSELARHHEVASPVLLSGTTLSTGSGTALVVAVGRYSQVGQMFQKLAYDAEPTPLQRKLNALAEDIGNFGLISAVVAFFVLLLEFWTMYFFQDPATRESALDVVHDHVEFFVTAITMLVVAVPEGLPLAVTISLAYSIGQMLKDQNYVRRLAACEIMGGANEICSDKTGTLTKNQMTVTQFWDGEKTVVIPSTRSAARAAAAGDASRRPAAGAAFSGGGGEVELALNSTTRSDNSRPPSGYMPLTATSTTASSASPHSAKAVEGGSWEEQVDCEALLQLQEENTKWELLMQAIALNSTAFLEPEDVVVAEGTDEETTVTNVKHVGSPTECALLAFQDQHCGGDYASTRRRFLGEDEVQLIAREDFSSDRKMMTSVVRVPRDGDAGSPCILRVFVKGAGERVLAQCSSVALSSGAIEPLTAAKKAEIEKTVVNAMASEALRTICLAFRDIDPEVESDWRERCEPPLQCCLKAETNLTCLGIAGIEDPVRDEVPGAVAQCQGAGIKVRMVTGDNIITAKSIAKRCGIFHEDAGGIAMLGPDFTRAIGGVVCQACQTEVCACATDTKTAEEQNRPLRVDVVRDIDAFDKIWSRLEVLARSQPSDKYALVTALKQKGRVVAVTGDGTNDAPALKKADVGFAMGLSGKEVAKQAADIVMLDDNFTCIVKAVRWGRNVYDNIRRFLQFQLTVNVVAVVLTVVCAAVEREAPLSAVQMLWVNLIMDSFASLALATESPTDDLLNRKPQGRDSYLISRTMLTSIVASAIYQLTVMIGLIFWGERFLPETKWSFLTDEERKTLGFCEFSDCDFATYTGTRMVSGRRYKLFSTEDDYKLDWLREVGPSRHGTFVFNTFVFMQIFNMINARDVDDTQIEKTSLAASILGMMRNRLGLGIWVLILVGQVLMTECGGRLLGCNQEGLNREQWILSLLIGLGGLLWGRLPRVFPWLYQIAPELGSREEMLEETHSIALELRGRTPGRINERLGLASYTFAKKYAKKARLMTLSRLRSRRLEGGREGRSKGISSFSTLARRGLAPGRGEGARGSPRQHRSGGSSPRGAGCLVEMR

SEQ ID NO: 152 - protein, 329 aa, Neospora caninum
MAPERVQKRKKVAMVGSGMIGGTMGYLCALRELADVVLYDVVKGMPEGKALDLSHVTSVVDTNVSVRAEHSYEAALTGADCVIVTAGLTKVPGKPDSEWSRNDLLPFNSKIIREIGQNIKKYCPKTFIIVVTNPLDCMVKVMLEASGVPTNMICGMACMLDSGRFRRYVADALSVSPRDVQATVIGTHGDCMVPLVRYITVNGYPIQKFIQDGIVTEQQLKEIAEHTKVSGGEIVRFLGQGSAYYAPAASAVAMATSFLNDEKRVIPCSVYCKGEYGLKDMFIGLPAVIGGAGIERVIELELNEEEKEQFQKSVDDVVALNKAVAELQA

SEQ ID NO: 153 - protein, 347 aa, Neospora caninum
MSLVRLFSLTLAVPLLFSSPPSLPLSFLCLASEPGKPPEAVSAGPKTGSEEKTRSVSPHRPSDTTLQSGGANPRPPSAGTSEQPTVGVGGARARIPGLSLDFSGLGVSAPPLTKKKKKGPKLFTEETMGPWKKHPCLQQLDQAVQSIQAKGLAGKEAAKAFADAIIACGIRVVASDYDRTAISHHSGGSALPTDKHILQSLTRDFHWLGEELERRGIPLYFVTFSDRGENRDGRIAAGPLVEATLKASDAKFGARGVFGFFPPLYSDPDEYQALGLTGPMPMDKSFHVKQVSKVSGVPEEQILLLDDDVTNCVKYCKSGGIAVHVGGHDGFDFRHLHVVTKPALVMH

SEQ ID NO: 154 - protein, 536 aa, Neospora caninum
MQSLRRGAAIPSRLLPRRDSWLSLAPFVGPNNAAAWRKLRDGAQDVQKVIDRQSTPAKTQQIDWAKWEGQIAHKDILHCMKTFYTSQVQILDLALGALEKARTPAPCEGAEKGWALYDAALRACTKSVEKSEELLANGARALWVSCNNPPVWKVNTNEWLDSDQYWQAFVEKHHFYSQYQPGVADPEAPQEIEAFKQSWHSRMSKFNDRSDTPMLYAYMNELPSWEYYDLHRSAFLEHMTYFLVRTGGDFRFFPEMPPWQWLAHIENLRFKLLSVAQSRRSQLQLANLERERALDFLPVDVEHHGEEYTQKFLQFETDLFQACAARLMGHFMFLCDPFVPVQSAEALSAVAEIDGGKGKLFSLGEDVNALFYLPEQQKRDVARPSQAVHALLSHLEATGRPFNPCYSELLHVHAEVLEERGEHWLTAPGECTSQAFLRRLRTDDPAFEVYCSYFKEMYERFAAATEVSMEEGRKRLATIAKNAQEEADAYGLALRTMGSTEMAQKAREGAAKLEQLREAQKAATAGQAEAVKDSKM

SEQ ID NO: 155 - protein, 550 aa, Neospora caninum
MVPPGSSRSFRLCLSSHVSRQALLFFTLSALPFFLCLSSLTPGLPLPVQALPPRSRLRHSSGHLESPSLSPSARIFLETSEPYDSPEDDLLEDGDDLELSGLADDAYRTAGGIRGTAGSGGDPADADVTALPGPVLPASDAGTETTPPNDVSAFPSRSLPTEDGSQDINNLDAKADALSGIGSDGKLNDYDIDLGPTAYEKIKMSQEIARGAAEEAIPSGPENTPSVESDGDVSEGVGGQAKEKAKSSNSLEKEVALPEAAEGSPCTKASVETRLKEIGCPLQLTNKHFALDYKQGVRIKGREFREERASKVAYVPQAVSEAPSYEPLAGIVLVADIDEPGIGSDVRLLHLVVRPSVCEEKGAERCTIPYLLPPVPVAEPAHRIVALGFDSPTGKRFKITEVLKLIQQKPQDVDLRRVSLSRLIEENAEFFRVNTGTTASPSWNVFKVYNAGQAVSSGEGSKALSAVDVPSNEVSKDAGSEKQATETAEAHETEGDGATKPEFGGYSPGSGGQLKPSTIFGYVLGSLLVIAVFVGIVVVTSDCVSGATKS

SEQ ID NO: 156 - protein, 190 aa, Neospora caninum
MVRVSAIVGVAASVVLSLSSGVYAAEGAEKPLGGEGQAPTLLSMLGGGRAGRGLSVGQSVDLDLMGRRYRVTRSEGAPDVLEISVLDADGKASHIGFVSIPEVMDTVARMQKDEGIFLDALSKGETVKEAIEDVAAAEGLSPEQTENLEETVAAVATLVRDEMEVLKDQEKLEEDAEKLAGDLEALQGQH

SEQ ID NO: 157 - protein, 378 aa, Neospora caninum
MASTVAQHRQHLASLLLFQWLAIILAVARGLDPVCGEALGHEGLPLRRTDTGSHSSGKSKGSTHHVPLSEMTFWSWMSYLKDLPDIDESRSPVLKRLLSGSILRRDGSTSVNIRVPAKELVRLLSLSEEQEKEGVSVKVRLINLLDPKYSVYEAYLYREVLPKKSPLLLPSLGEFRGPFLTYIFHPLTKGLVGDMLETGRSLPDLQLLAANMVAGLHSLHKLGLLHRSIELNSFCILSDGKVVLGELQTAAPIGTESRVWAGLLGRETAPEIDRNFLADFALTQSRHTVKSDVYSLGVAFRNLLQLVGNGSMGPDDGGIVRRDHVERLDRLSQKMIDEEPANRPNLEQIMKDPLFEGLSFQEIEEGIVRPFRHRQERL

SEQ ID NO: 158 - protein, 945 aa, Neospora caninum
MADPTWSCRETRTALEPEMLEKMKSTYWLTRIVFLRALCFVYFVAFLVAFNQAQGLVGSDGILPAQAYVTNVTRAMAGEDAWDKIKAFPSLFLVLPANDFWIHCLPFLGLLLSLVTAVLGGGNGFVMLFLWILYHSVNSIGQDWYSFGWESQLLEIGFLSIWLFPFWSCSRLPASWPTPKICVWGNRWLMFRLMLGAGLIKLRGDSSWTDLTALDYHYETMPVPNPFSWYMHNQSHAAHAFQTIVNHIVECVFCFLLIVPFRQCRLFGGVTQILFQAAIIFSGNFSFLNHLTIVPAIMAFDDKFLTCLFPSKTLERLRPLLQGCPGAWSLPKHQAWPLDSVSGHKEGNQGVGAGKDPESAALLNDGEGRPDWSLDIDDSSQAPPRTCCCWYSPKLQRFFRSFPRVIFPPRARDQMKQDLEESWRKMLLECVAAGGAFTLMAMATTSGSPSLLNMMGTLLLCLLLAASSHLYTKTITSNVFAELVLLVASLWSAVSLYKHGPSPLRLWLMIFLFSILIAFSYKTLQNAVLIYRVHVELLLLIIIISLSIPVVANLLSPNQERWELIVQGTDDLTPDENSTWMNYEFKCKPGDVNRRPCLIAPYHYRLDWLMWFVPMDGAEMAFGRHPWFPRFLAKLLQNSPSVTSLLAANPFKNKDPPTAVRVLKTLYRFTKRPAFGSGPWWEVVPQSTTVYVAPSDVPDADKHLEQMLVLKMGQERKAEAERLRKEEEELKEEQRKARERAEAERKAEEAKRKKAEEERAKRELEEKKRQEEEEALRKKEEEEMRKQEEEQRKKDEAEAKARAAAEEERKKKEEEMARLQEEQEAERQRVAEDEERKKKEAQRKAEEEAAKLREEEARKRDEEAAKLAEQRESLRRAEQKDQQAKQKLTESAEKAQNQKKIQAVAQKEGKSQMSAPGIESAQGGVPLRAAALFTRQKRAKLNQVH

SEQ ID NO: 159 - protein, 681 aa, Neospora caninum
MVRVPEQAWRRLAQRTLFLSSPSEPARAACVSPGVLAAKQAADEKSFDASSRIRLWAALAAGVSSVVFFSDSYQRADKRLARAFGNAPRAVACAEKPKGKAVDLGAVEDFEKGGLYEVAVNGGKDKVLLSRTADGTFYCTGASCSHYSASLVKGIVTAKRTVTCPFHDAEFDLETGKCVNGPALSAIPTYAIEVKNGRVVAQIPDEVTVRAKGVYAKEKKGKKTETFVLLGGGAAAATAAETLRAEGFDGRIVMICEESVPPYDRPVLTKNLNAKVDNILLRPLQTLQEELDVQVLLNSRAVGVDLKKKTVRLEGGAADVNFDKLLLCTGSETRRLSGLPNGTARGIFTVRDVNDLQELGKFLEENSRFNSNPRVAIIGSSFVGVELASAFQRRGCKNVTVIGQESVPFERILGHRVGESIKQLITGKGVRYYPHSKVTGFTSTRNRVTGVELASGEIIQADIVLVGIGSVPATKFLANQADFALARDGSIVTDPLLRLPSNPDVYVAGDIATYPYVKTGEEIRVEHWAVAMQQGRVAALNMLGRHVPFTQIPFFWTMIFGKAMRFAGWVGSGFEEVIVEGDIDKQEFVAYYVKDDRVTAVCTMARDPVAVAAVELLEQNLMPSPGELRQGLKNSQDVVALAKVRDCPSGARELRQGLKNSQDVVALAKEAAATKTVKRLV

SEQ ID NO: 160 - protein, 406 aa, Neospora caninum
MKRPALCFAALVAAGAIVSTPNVAAKNLARSLGHLDASKLFAAMLSPDGESRNASLPHSLSFAEGGAAAPADRPRDAGVTDLASQLRVLKKRSDERRKDNERRQKEWDEEKAKRAATRRQIGGEESAQVDPMRRQRDRLDACLRQASQEPPNIEDLCKGVEIPDDCRSVAQHILSRQDFSKLHVTSMNFHIYFNRAPLAFLFPVLDATDLRLLVKLYMYITKFEGCDGFSVADYIQLVAMDVFSSEEYLAKANHAADVFGEKDAQLVPKPGWKVAAVTRWMKAKPDIKFFEQPFLFVTAAVAAMLEVTLRHPFLTQLVDMACVVRPLCRKGLREVLLWSLEQNSMSVQDVPLDSAPRPLVDQLRVYLRTLLVGKYKRVRSNGGRVAAQFVYAYGLKLSEEASGTKL

SEQ ID NO: 161 - protein, 769 aa, Neospora caninum
MDPQHHLSPAAVDNAVGSRGGVGQSAGLQPQPKRYVPPHLRNRPPADYSGGVGASGGYPEYPSSNTPLASQQGAHGPSGHSPTDRSSYPNATGASNGLSAGSPGQGTQGRRYVPPGSGDRFSCLGAGAPRYTPPNAAYSAQGQGEFQGNASGGVYNARAAAMQQGGGYNSRSMRASATGTGWDVRDGRRYVPEKEKEVFSSDKLQSTGIKFDSYDKVPVELKGRGAERIMAIESFQTPGMQIHPLLLQNVSRVNYTKPTPIQKNSIPTILSGRDLMACAQTGSGKTAAFLYPIIARMLQDGPPPLPQAAAGGGSGYRKPPAYPICLVLSPTRELAMQIYEEARKFQFGTGVRTVAVYGGSDVKRQLIDLDGGCDICVATPGRLVDLLERRKRSAGPGVSCKSGQKASPSPECSSEREVRLGLVQFFVLDEADRMLDMGFLPQIKLIVESFDLPPSPSPQTAGYPSLGGDSGPGRRVGRQTVMFSATFPREIQMLAKDFLEDYIYLAVGRVGSTNEFIRQRLQYADEDQKLKLLVKLLRETEKGLTIIFVETKRKADMIEDYLVDDDFPAISIHGDRTQQEREEALRLFKAAKCPILVATDVAARGLDISNVTHVINFDLPTNIDDYVHRIGRTGRAGNLGLATSFVNESNKPILRDLLNLLEEAKQDIPSFLPPLVLSCTSSSSRMGGGWGGGRGGRGGRGGGGTFGGRQGGAGYGSMSGMGSRAGAAPMGDSRLPASDWRTNPGGSRPMGGFRAAVMSGDRPGGMDAW

SEQ ID NO: 162 - protein, 544 aa, Neospora caninum
MAVNEIFLLFESAPGLLLARVKGWDQIAQDTDAVQEACLDFGRFKQVVEAIAFHPFSDAEEAMEVQLAITNGTSCASLVNFLNFNLPSSLKKKKGADTVDGSAARAKSQAAVGVCDPALGKSLADAGFQIVFNSNIQELHRGCRQHMKKLAKQLGELPIEKFQVGLGHSYSRSKMQEDPRKQDKPIMQSIALLDSLDKNINAFAMKLKEWYGWHFPELVKIVGDAEAYCRVLKVVQMKEQFDAQAQGEELLEACGGSEEIRDEVVAATKHSMGQEIGEADFVNIIRFADQVLRLCEQRRNLQDYLSTKMDFVSPNLKAVVGEVLAARLISHAGALVNLAKYPASTIQILGAEKALFRALKSKNGRTPKYGLLFHSSFIGRVQKQQHRGRMSRYLASKCALAARIDAFADEESPESADGVRSNVYGVKLREQLEERLKYLADGIVPRKNLDVMREAASELQTQATAAAAEKKKKKKRKHEEKEETNPMMDVEQESGEKKKKKKKKHAKPAEDGEDVDGEEAAAPAENMGTEKKKKKKKAHVDAEL

SEQ ID NO: 163 - protein, 203 aa, Neospora caninum
MQTGRQSVSVALLGLTTMIFLAGLSEGVDIPVRFGPETARADLLNKVSERVFSLVETTEDDESASSIVKAAFKSALKQVLTAVKGEVEKTCEELADLAAERIRDAENRGEEHQEKEHDDVSDFVFLDSSKKSETSIRPHGFLQETKFVDTLKALAKGALKSLAVPMKAAIVEGVKPMLPKLKSTAVEIFKQACQQAEEKVQEA

SEQ ID NO: 164 - protein, 187 aa, Neospora caninum
MGVDLEHNGRKKKGGRRTVKSQNPYLRLLVKLYQFLARRTNSSFNAVVLKRLMGPKRLKAPMSLSKLARHMKDKEDHIAVLVGSVTDDIRMVHVPKLSVCALRFSETARRRLEKAGGECITFDQLALRRPKGSKCVLLRAATKSREADKHFGAAPGTPGSKARPYVRSSGRKFEKARGRRKSRGYKN

SEQ ID NO: 165 - protein, 540 aa, Neospora caninum
MMCSRIPTGTTLCEYAESRFRLRSPMIHKKKQCPMASRHPRTWLLGTIVVIWFLEAVTFAYGVRHKKPSTPLAKTRSSPLSSMSYSSEGTSSGDESGTARALVLRLKQSARRAAESLTARSQLYRELQNQDLTPISLSRRPDFSAGLGVLLSQGRRYRLPLPSQEDRSLLRELLVAEGSLNPPSSSPPLPMRLRQFPENGEGKIVNFLGLAGKQNGFMLLRMQEQQDGGNVPDHIYWQPLLRSGGASDKDSVDPQFVKTALTSRAQRESSLLPPGYVGKPDSVFSQFGLMFAGGVFTLGSPDAPLEFIVDESAEDGWRTALNLFLRYPPADVPLSHVLCKRLTPTLAAFLVKQVILESAMMQAMGLVHLGISIASFFFSGNEVIGATPANRLLYLGNTGVARYYTGQPEPFEETGHSMYHDPSTASNLKRVAPLRHPVVFSPSRDAWAVGVVIFQLLCGGHPHPFGSLGSPASPLVTASRISRLAQTRPQLRKSKCFNPSSAPDMEDLQKIMDLLLAFEESERPTTLDILREYPHLFPTS

SEQ ID NO: 166 - protein, 466 aa, Neospora caninum
MERTADNAAPLEQTVAQEEVRASKPQVMDENSAEAANKQEAAQSVQDVSANDIQKFLADQSPASAKRLIFSATKTTTTRTMSKTVSESVSHKQTKEVFTAANMAHMGWKASKEAFLAHSSSFASQNDATETEIARFVPSVQVVDLPLDLVYTVPEVKTRMVNYTFECPARGYSRLVPRAFPVDTPFIVPQYEDVRVPVVMSQTFVPELQETSKVVQVPVARYVPKLVPVDVFVPRPVAIPIKAGEVTQVTKNTVISEDLMHQLSVEMNPHLQALNKFNAQQAQAMDSLVNKANELATQMDCPPPAPERIEVNEKACGVIPVVDEQGNKQLKIDLGGKDPRSVEMVFKRLHDDADTSKSVEETVQLTEDIILCVHRDLNGGRLDTFPSGNAGIPMIFRAPDEKQGFSACPGSNGLPEPAPLRSLTNDMSLVSASAEAQNDSSATTTGESVPAALGAEEATTAVPIAA

SEQ ID NO: 167 - protein, 540 aa, Neospora caninum
MSARATSPALPPPSLNSASRSALSTKGTCGGRPGLSSSPLCSAVSSLPSSLSSGLGLSPVQPGKNGSRPAQPQPPSRFFASSVATGGAFNLEGKIQVANPVVEMDGDEMTRILWAWIKEKLLFPYLELPLEYYDLSVTNRDQTEDKVTLEAAEAIKKCHVGIKCATITPDEGRVKEFNLKKMWKSPNGTIRNILDGTVFRAPILISNVPRLVPGWKKPIVIGRHAYGDQYKAESLVCEGPGDFTISFTPAGGARVEKKVFSFSGPGVMLGMYNTEASIRGFALSSFKFALQQNMPLYLSTKNTILKQYDGMFKDIFQAYYDEQFKPLFEKQGIWYEHRLIDDMVAQALKSEGGFVWACKNYDGDVQSDIVAQGYGSLGLMTSILVCPDGKTVVSEAAHGTVTRHYRQHQKGQKTSTNPIASIFAWTRGLAHRAKLDGNDRLGQFCLALERACIQTVENGAMPKDLAICVKGADKVTANDYLTTEEFMDAISDTLKMNLITHQAPQADQVVGGKLSNSNWEHYAASEHNSSVDDHDDNQRR

SEQ ID NO: 168 - protein, 642 aa, Neospora caninum
MEHCPLLQLGVTVLGLALLAYASLSIVRRVFKTLFSRKFQLVKFGEWAVVTGATDGIGKAMAIELAKRGMKVFLVSRNPERLRQTEQDLQSAVPSVKGVKSLAIDFSEGTTESLFQKLDAALQNLDVGILVNNVGISYPHAMFYDELDLHTLDQLINVNVRSTLVTTRVVYPGMVTRKRGAIICVGSGASEIASDPLYCAYSATKAAAESFCRSLQPECASKNILVQCHVPLLVTTKLSKMRKASLMTPSTETYAKSAMAAIENGSMRGPTTISPYCVHRCIIWLSNAVPRKVWEAAYLPRCLSIRKRALKKKEEQVRRMDLTVWTGVGTPKAPTVNPLVTFCEKEDVQLLAVQLPGRSLRSKEPVPTTIQNCVAQLLDVIAPLVSSRVPYVLVGYSMGSWVAYELACAIAKRRETDTKFRLPGRMILASMVSPDTPPSERPWRETRHLSDSEFQEELRGWSCNEILFQPDLWAAYGKLLRADHLLLDEYIPTKRDAPLGVPCSVFRARDDLKLQSPSHFVNWFSLVEGPSATRTERKDPSKLCSYGRSDTSANKRGDASTAECTPRDTDTVKPLDRESTGKAGSDAGIAPGSGLQQDDGNRIGVLDGSHGLMYDPKCRAKFFERILELVEQNLLDLMYDGM

SEQ ID NO: 169 - protein, 847 aa, Neospora caninum
MSLLAREESPSRIKKGETLDGGQLIQIIDYDGDIVGDIDAWMKRQNLADVGFNYNVITILGSQSSGKSSLMNALFKCNFQVMDHVHGHSQTTKGIWLGRDGISAASNAPPCLVVDVEGIDSRERGEDRQTFEHRSALFALALTDCLCINVWYHSLGNFTASGYGLLKTVMEVNLELFAQDKNTPRTLLLFAVRDWAEVMTPLEVVKEKIAREYVERIWNEIKKPAAYENSTPYDLFDFQVFGLAHKFMNPEQFDRDVAALREMWRTSLRPPRYSRHVPADGFARYATSIWEVIKEQEQLNIPNQKEMLAIYRCQEIKTSVLSSLAGEVSATQAKVQQGQMDEGAFSQWLQRVATAALAEYMEHASRYQSDVCRRVKGELLEGLTSTVQPVVDGLLSRARDAIANDFLEKLTASLAGRLVLDAWSTYNDSSAELLRDAQQRFLAAARACNADLPDGSHIAFSTELVLDGMTHMLTKDIETVRDKQQVQLVGLLQTTCDGKLIGVADSLSSRGFTPLKFWEICRSKAASAAGDCFSMFFNAHRGLSSQDGTEGSDESRKVEFEIQCRVLALTQLRKQIENVVANLHVLILDRFQTFFSYDEEDQPRQWESLSPEQLQKIFVEAKEQALVLLPTFTCMRLHPLSVATPTLVPASAPRGPGVPSSPSSASEFFETSVLSESEKCELTPFLPARFFSDLLDALQTQATHQKTLRQMQQMCRDAQMLQQGRAAVSWRSVPLWGWLVLLALGWNELAALLHFVTGNWILLPFFLLTVVAVAAAVFTGNVGVVLASFNHFVLLAKTVAVPVAKQILIKALNAVEPQPAAARPARSAREISASALGGAKAPETISR

SEQ ID NO: 170 - protein, 116 aa, Neospora caninum
MVAKKSAKSAKPKASGKSGKGKKKRAESYSSYIFKVLKQVHPETGISKKSMMIMTSFIADTFDKIASEAGKLCKYNKKDTLSSREIQTAVRLVLPGELAKHAVSEGTKAVTKYTGK

SEQ ID NO: 171 - protein, 318 aa, Neospora caninum
MMRSFKSILVPLSAVVATAELGFLPNSHVYVVGAETNDVALSLPEDVQENPEGHSESSQEVDVFGEGWNKFEGPGFGEFPSVDFRHLYAQVQEMMRAFSGLGVEPFGRPFFGESPGSPAFPRLRIAKPKTSLKRVGACRYVISWMQGVTANNVRVVLHLQSRQVEVQYRACTRHDEKTEHGESHSESREQSSQSVSVDPECIMTREVVAQKLAGWADNGESVPPGSPKKLLITFPSPEHINQLIKEGHVPEGALEKVKGGDFSDFTPTQMCLLSGRTPHECALAEGQQVELEETPLPSSPSTPDSVDLPRFSNHNGEI

SEQ ID NO: 172 - protein, 141 aa, Neospora caninum
MKFSSQVSSSRRKSRKAHFTAPSSVRRKIMTAPLCKELRRKYNVRSLPIRKDDEVMVVRGHHHDREGKVTKVYRKKWVIHIERVTRDKANGETVTIGIHPSKVVITKAKLDKDRKALLERKSRATSKGKYTEKDVAMSQVD

SEQ ID NO: 173 - protein, 195 aa, Neospora caninum
MVKYAKEPSNENKCCKAFGQDLRVHFKNTHATVQAIKKDKRGNPMKLSAAKKYLEDVMEKKRCIPFRKFTGCIGRKAQAKEFKHTQGRWPVKSCKFVLDLLRNAESNAEMKNLDVDNLVIEHIQVNRAPKGRRRTYRAHGRINPYMSQPCHIEVILREQEQPVEKPSVEGVKAKTVRLTKKALARSRLRVGGGSN

SEQ ID NO: 174 - protein, 311 aa, Neospora caninum
MAFVKALKNKAYFKRYQVKYRRRRQGKTDYAARRALVLQDRNKYNAHKHRLVVRLTNKRIICQVVYSTIEGDRILASAESTELPRYGVKIGLTNYAAAYCTGLLLARRVLKHLGMSEAFEGVEATGEEFHIEENFGERRPFKVLLDVGIVRTTVGNRVFGAMKGAADGGLHVPHGIKKFPGYSKPEGEGEGSYDPEAHRARILGLHVADYMRQLKEEDPEKYSAQFAQYIKNKIEADDIEAMYKNAHAQIRKNPDPVKKERAANAQNVRQGNVIKTAKGQYVRNVKLTKAQRRERVQQKIAMIAEQMAAEA

SEQ ID NO: 175 - protein, 390 aa, Neospora caninum
MRSPTPQQHWNEPLARVMDIILNCTIRFKTAAEVGKRAVFYCRGEDLFAWMMDNREMLQKKHADALDGQLLTTEAEVVEFCDKLIRFGFMYRAQYKPIDGVIEQDEEGRFKRPKWPKRLAMTPKQNFDPQAFYVVVYEGSKSWQHFILFCIIAAVLCVCMFPAWPLKLKVAVWYLSVVLLTLILVLVFVRLVLFVFFWFFGFQFWLLPNLFNEDAGIIDSFLPWMEWQRSEDDWAMFAARIFCAILTAGTLYKLSETHTPASVANFAKQSFLDVLDWGHQRLAAPPGGYSKYASITDKQEGAQGTEEEGEGNEENGEAKADEDEYSCLKPCGFASFEHLMQARCLVKCKCVGDLLESKCFPKCPEATQAALREAARDACEEEQKRKKKRH

SEQ ID NO: 176 - protein, 564 aa, Neospora caninum
MSNLQQPASPAGGSLIGVTPSNAGGEVERVNVRLQADQPVVPVPVYQDVYKRDKYIEVPTVELNDTIIPKVYNQSAVHEVPKMDIAFHEEEVAVQAEKPVDRDVEVPVLVGYAPQFVPKWDVREVPQPVPKYEGEQEVIEVEVPEIEYKDTYVEKEVVVDVKEKIVPKVTEVVKEVEVVQYEWKQQYQDVPVYKYVPKFDVELDCPPPIIVPYPETRFVKEDPDVVQPYCAPFANCCPGKSTHKVVTSDRLFVRTVEGTPAVQSNTPLVTVGGAFHSMSPDVQMQSEAIPHAHSVLPSDYVAHGHLVGDAPGVSSQGQLPNVQLAPGPVFPMPSPQVAQSTTPLAGASSGSDAKQEKTAASEKKSFWNWLFGKEEETDKLAKQKEGVPDYTAHFQQMHQQLEQQSLPSARTDEQSGKDEAASNLEPSVVYKGVVSRPAVFGGNLNPISFKLHAIEIHQFIPLPNVRVPEFVKALPDGLMATDVSGLDRFFGPVPTGWADPDVTGIPAPMMSDILAGNIQASTTSPLINQLSEKIAKQDNTLQQSEADARAVSEVGLVQEAHITA

SEQ ID NO: 177 - protein, 686 aa, Neospora caninum
MDLSPSFAENGGQADDNSNTENNRGSGADSPSPSDAPKAGESASGATESAGTGGEPTGRRRRALRNLFSRFSGCTFCGRMRGRAAAGDAAAQLGEAVLTALEGGAFDQDLLGCIKIAPDMFFPLAATCRSLKVLELKASICINRRKNLADVLTAHRELYPDSIGFIRNLVLPVSHPAFVLGRESPQSELDIEAFALLVKNAVEKRPITPGTYSIFDDASNRSCVATQMTHKLKDCPLKASEKKSWRLGQLAAALYPPHADALDLRLLLSVLDLSDCKRRWEKRPVILVQVPGREKPVEVPKKLATHLLLSAVISRAYSANESDGMRCRRDGELTSKHEVSCRRLKQVNQMRRIVQAIFESVLSDDLSEAQTIAGTFAEEWRTSRVDDSMIERVNKFVVGHAFADIYAFLEEKLESRGTRMLRFLIRMKLTKFLTWYVARLVSKLSNPTRPEAAAVSPHSDRGIPNEVLNAASIASAAHLACGGFENWVQKFAQELVFRVLKRHASTQKTPEKARTAFIEKVGASDFDSEIGSEAPKAASHDNGRAAASPTESASSFLGVNGENSPEVETEPQETMGTPLTTSLASGVLAVDKVISSSKIRRSIAQLLTVLIVITLAADFTLPDWFPGSPVKRVFMSIQGREDFKPHQFGRLGQPGSFQQYTMDRKKTAQAINGNGVAAGFLGTVVS

SEQ ID NO: 178 - protein, 134 aa, Neospora caninum
MGLFTRYYQPGRLCVVQYGPDAGKLCFVVDIINQTRVLVDGAGVTGVKRQSMPVRRIALTDQYLKIPRSVRSATLKKALEKDDVIAKFNQSSWGKKRQVKEQRANMTDFDRFKLMVILKQRRKVMQQKLKTLKK

SEQ ID NO: 179 - protein, 216 aa, Neospora caninum
MSKLEKKCPVCYQKLPMPADVLGPMDKELNYFMWMPGFEWRPEPVRESADAYGDVCDSPSCRQEFRPAADEDMEEALEEMVEADEMRDRFNERASGGKVSTNDAMILARQLGLAPSYGDKKEFEKNSGDSLDYTSFQKFVGASTHPEDNIEDLVEAFAYFDTSKHGYLTRKQMGNILMTYGEPLTEAEFNALAAEFFTSDQIDYRKFCEAMLARKE

SEQ ID NO: 180 - protein, 151 aa, Neospora caninum
MGRMYGPGKGMSASALPWRRKPPTWLKIKPSDVEEHIVKLAKKGQTPSQIGVTLRDSFGVPQVKSVTGNKILRILKIQGLAPELPEDLYYLIKKAVSVRKHLERNRKDKDAKFRLILVESRIHRLARYYKRTKQLPATWKYQSATASALVA

SEQ ID NO: 181 - protein, 228 aa, Neospora caninum
MQICCSAAQPPSSPIASPSTHVHQNQEHLFLLPPCISLYKVVKMSCCGGAVVEHEVVLDSASEGDDLLPDQLIPSIPRSGNLLLAANKIAEIQAPPEIRNKITWKPGVDIFFDKKESTIDLVMDLPGFTKDDVSVEVGEGQLFISGPRSKNELREKYGANLVLCVHERPTGFFLRAFQLPPNAVEDSVHAVMTNGMLEVKISCIQTHERKKVEILLPGAAQAEKGSKK

SEQ ID NO: 182 - protein, 210 aa, Neospora caninum
MPPKKKALLKVIILGDSGVGKTSLMNQYVNKKFSNQYKATIGADFLTKDVVIDDKEVTVQIWDTAGQERFQSLGVAFYRGADCCVLVFDVTNPKSFESLQSWKEEFLIQSSPADPDSFPFVVVGNKVDEREKRRVSSSKAEAFCRQSGNDIPYFETSAKTATNVHLAFEEIAKRAMLQEKQQEQIYLPETLTLSNPDIRPAPIDSSGGCC

SEQ ID NO: 183 - protein, 161 aa, Neospora caninum
MATADVQTERAFQKQDGVSSLGRVHLTGQKKRTQRYWKDVGLGFQTPRLAKESKYVDKKCPFTGNVSIRGRVIKGMVVSTKMKRAVVIRRNYLHFVPKYSRFEKRHKNVTCHLSPCFEQVKEGDIVTAGQCRPLSKTIRFNVLKVEKNQVFGNVRKQFRLF

SEQ ID NO: 184 - protein, 201 aa, Neospora caninum
MAAKDEYYDYLYKIVLIGDSGVGKSNMLSRFTRDEFNLESKSTIGVEFATKSVYLDEGKVIKAQIWDTAGQERYRAITSAYYRGAVGALLVYDITKRQSFENVERWLKELRDHADPNIVILLVGNKSDLKHLRAVSVEEATKFANREHLAFIETSALDATNVEQAFHQILAEIYLLRQKKQIEDNPQSTAQPGRGQKIHVS

SEQ ID NO: 185 - protein, 250 aa, Neospora caninum
MAEQTEWARTAEESTLEKEHSLETLKTADMEAPSLQYAGTHVIKKTVKSPPEVIEEMRTWLKTGVAPDGTRMMTEEAWQWHQDYYQCTVRSDTHHECLPEGAGVDFYYWHAPYVAHIGDMNLVMMHSQVNLPDGTHLPSDRLRAETAQSKRLRQLAEKRTELEARRRDEFVRQAMDPHAHMGDQYRKEGLYTKLFYRGQAQEQKEEEHPELKWASTVQLEARAAEAEMAKAAQEEAPAVEETRAIDNEQA

SEQ ID NO: 186 - protein, 188 aa, Neospora caninum
MTKSYRTYSKTARSPKRPFEKERLDQEMKLLGEYGLKNKREVWRVQYALAKIRSAARELLTLEEKDPRRLFQGTALLRRMVRLGLLGESEQKLDYVLGLTVAKFLERRLQTKVFKLGLAKSIHHARVLIRQRHIRVGKHIVDIPSFMVRVDSEKHVDYAITSPFGGGRPGRVKRRSLKGGNAEGGDDE

SEQ ID NO: 187 - protein, 171 aa, Neospora caninum
MGAAARDWDENVLPRATAISIPKHFRRSQKPGVSSKAAHKKMVRMNVLADCLKTLVNAEKRGRRQVLIRPSSKVIIKFLQCMQRRGYIGDFEIVDDHRAGKIVIELLGRINKCGVISPRFDIKVDKIEQFCSNLLPSRQFGHLVLTTAYGIMDHEEARRKHTGGKILGYFF

SEQ ID NO: 188 - protein, 343 aa, Neospora caninum
MDLFRRLIPSNKDGAGDHSQRGRLPPNKCVMSNFNFGPTLGTGSFGRVFMAKRRDDPNAPPVAIKRLKKAAVIRQKQVDHILSEKRILQMINHRFTVNMLGTFKDDRYLYIVMEYVIGGEFFTLLRKTRRFENDAARFYAAQVTLIFEYLHDRNIIYRDLKPENLLVDAEGYLKLTDFGFAKVIEYRTYTLCGTPEYIAPEVLLNKGHGKPVDWWTLGILIYEMILGYPPFFDDEPMGVYQKILGGRIAFPKFFDKNAKVLVKRLLTPDLAQRYGNLKNGVADVKDHRWFAGFDWNACLKKTLPPPYKPPVKGMDDTSNFEAYPESTEQAPPVTGTMDPFTSW

SEQ ID NO: 189 - protein, 454 aa, Neospora caninum
MNSGGKYVPPSLRGGAQPGAAQGGLQGSAAPAAFAPSAVPSSPYGAAGPALSSSPASSLNAGGVSPGDDVSPQGVSPNQRRTAAQVLAGMSGTGASRRAKASYPLRVVEVDSLVLMKVLKHCKENYPTPVNGQLLGIDCKDRLEVTNCFPLPQKKDIIAQVQREKGISEKDLEERIDEEFDKYQDKMAELMHDVNVDCFTVGWYQTLSFGDLKNKDIIDSLVLYQEAIDKAIVLGFDPMLNSMAKKAFKAYRVNPEFVQKYQEFEQDVSKYNKLRAKDILIEVPLVVVNPFLVEAFLMDWAVHDPLQNQADFDSLELDQSVYMEKNLSMLSMSLEALGDEQDKLQRYQRESLKQQQLQKQLLERRRLENDQRRLRGEPLLPADLDGPAFRKIDPPSQLNTLMMSSQAQLQCEDINAACSETLGKMFLLHWGNLRKKQTPAGLSAAVAAAAADAK

SEQ ID NO: 190 - protein, 581 aa, Neospora caninum
MSVSPRAGTRSSFVEVKLRVVCAVSCRMPMASQRGFAPCGAKFRRLVFYLFIFAAALTSNLSDVLGSFISDPDFFCQHGPCRFRGEYSLWPARPRQGSTRHVISISHVKGISFLQETESSPDRPLPDPESRTKLLVSLSTGHYGQWMTADDEQGRTKLAESVSRLTRSQLLEGMSQKLMAVLDHAIPEGTDIVVEPVPGFQEGDHRVQAFRRGEALGTGSFNVVVKATPVPMPSGVSIVQRPKYALSPSLSTKFTRAVTTGAGPAAGPQAHATEGASHDAAFPPEGVALRITTARARSVMGELEAEDKCVSLVRSYESLKRKLPSGFSSEELLNKFGLAVPLMAGQIRGRPSLLRQEHNRSVVNFVQVLPVMVCDVQNVRSGDRHVATFLVKRMIQLGAFLGAAGIVHGDIKLENVLVSRTGQLFLTDFDALVRVNDLIVCGKKNTPEFSPPELVRCILDTPQEKIPATELVDAWSFGMAAWDVLCMTWPFAGMDFAARAIHNMNVLAALPEVGDDTRSLDWGRCKRRPPSAEVRAAVECLLDRNPRTRCTALDLFMSSPLFAAGRPVSPEPSPGLASEVN

SEQ ID NO: 191 - protein, 139 aa, Neospora caninum
MKRGRGGAGGNKMRVTLGLPVGALINCCDNSGAKNLYIIAVKGWGSCLNRLPACSLGDLVLATVKKGKPDLRKKVHMAIIVRQRRAWRRAEGYFIYFEDNAGVVANNKGEMKGSAVTGPVGKECAELWPKISAAATAIC

SEQ ID NO: 192 - protein, 316 aa, Neospora caninum
MFIFNLCGHRQALCLWCMMCVTRCSRSGKAIAVRQLLGYVDTMTRVPVRRPLCSISATDTLEAELPPGGFVDLSAIKDSEKKEMFRKGKQACLAVPRSATMKDIKEQIKFVLENQQQKLSLFKDGAHLKDKHTFEDDAFFPQIKGVIRQKGMTTGSAFATAHPVTKDDVIATILVRCPTRLTRVEITDGISILIQGISNEYVVERQLDTAMPHFWKKGEQSSELVLFIDREWCGAAIDALLKFHTKISEPNLEVGGSVVPKDGFLDDRDTYPTALIDARLKVCLGFLSASKLLKDEQDNVLHSANFFPIPKPSISF

SEQ ID NO: 193 - protein, 475 aa, Neospora caninum
MLRRLIPSYYSHLVRFRYPFSASYPSLTFSKMVAIKDITARQILDSRGNPTVEVDLLTDGGCFRAAVPSGASTGIYEALELRDKDQSKFLGKSVMKAVENIHKVIKPALIGKDPCDQKGIDKLMVEELDGTKNEWGWCKCKLGANAILAVSMACCRAGAAAKGLPLYKYIATLAGTPTDKMVMPVPFFNVINGGSHAGNKLAMQEFMIAPVGASTIHEAIQIGAEVYHNLKNVIKKKYGLDATNVGDEGGFAPNISGATEALDLLMEAIKVSGHEGKVKIAADVAASEFFLQEEKVYDLDFKVPDNDKSQRKSGEELRKLYKELSEKYPIVSIEDPFDQDDFHSYSQLTSEVGEKVQIVGDDLLVTNPTRIAKAVEEKACNGLLLKVNQIGTVSESIEACQLAQKNNWGVMVSHRSGETEDSFIADLVVGLRTGQIKTGAPCRSERLCKYNQLMRIEESLGSDCQYAGASFRHLN

SEQ ID NO: 194 - protein, 473 aa, Neospora caninum
MAKGFRFLNLIKPVMCILPEVQAPDRKIPFKEKVLWTLVSLAVFLICCQIPLYGIRTNKSADPFYWMRVILASNRGTLMELGISPIVTSGMVMQLLAGSRIIQVDQSLKEDRALFQGAQKLLGLIITVGEAVAYVISGMYGDIHDLGATNAVLIILQLFFSGVVVIILDELLQKGYGLGSGISLFIATNICETIVWKAFSPTTIKTGKGTEFEGALVALFHCLFTKSNNIVALKEAFYRSNAPNITSLLATILVFLIVIYFQGFRVDLAVKYQRVRGQQGSYPIKLFYTSNIPIILQTALVSNLYFLSQLLYRRFKTNVLVNLLGQWQEVDVGGHSVPVGGIAYYISPPGSFGDILEDPLHAFIYITFVLVSCALFSKTWIEVSGSSARDVAKQLRDQQMVMKGYRDSSLVQVLNRYIPTAAAFGGMCIGALTIIADFLGAIGSGTGILLAVTIIYQYYEMLAKEREQGNSIF

SEQ ID NO: 195 - protein, 609 aa, Neospora caninum
MKTSPLPSSLSSSLSSSGSSSSSGSSCPLRPCGAGCASCVLSRAQPASRGSEHARAFAAGAGPVFEYKKVLNCERPVDQQFKRLDDLSEMVKTVQVPGLEEPLLRVSPELLTALTKYAFEEISFFLRRSHLQSLRRIFDDPDASDNDRFVALTLLKNANIAAARVFPGCQDTGTAIVMGKKGASVLTDGTDEKAIFKGVFEAYTQNNLRYSQVAPKDMFTEYNTRSNLPADVTLLSTPGKVYELLFIAKGGGSANKTFLYQQTKALLNPTSLYAFLEQNIKTIGTSACPPYHLAVVVGGLSAEHTLKTVKLASCRYLDGLPTSGEGNSYGFRDLEWEEKILKMTREIGIGAQFGGKYFCHDVRVIRLPRHGASCPVGIGVSCSADRQLVARIQADGVFVEALEENPAQFLPDVEDEHLKSEGASGEAVKVDLNKPMKDILAQLSQYGTATRLSLSGTMIVARDIAHAKLLERLEKDGDVPEYLKNHPIYYAGPAKTPKGEVSGSFGPTTAGRMDVYVDKFMQKGGSMITLAKGNRSKAVAHACKKYGGFYLGSIGGPAAVLGRDCIKKVDILEYPELGMEAVWKIEVEDFPAFIVIDDKGHDFYSKWLG

SEQ ID NO: 196 - protein, 1122 aa, Neospora caninum
MATESSRVNGEGALAPPSIYHPSSTPAMILPKRHASFSCYDGTSASGTGASTTSGGSAVGDMGNALSSRSLLGGRPVGKLGDSTLFGTMDPTSTSEFRPMSQKYAAQYEEVKQILAQRGDLSKRVISANADAYYNHLGLNEYYFQTATAQTVASNLACVIAAKILNEFSHSDYFPQIQQERDGEVFLLARASLRNRKASQNYQVEREIERKFLGLSGKTTPYRMQCYRSSGSFFDDPADENERLRTYFLQQPEYCAETAKEGANPCETDLSKLLDVYFYANKRNTATAEIYRRLNEEVVRDSSGQNLFINVVPRGTGYRMDLAFRRGLHTKEFFSRLGDSVTMWGFYSQRKYVEPLANGVSIITTFIEELPEDQLTDFPEMSISRRVERLVKAIRMQYIMQPSKFTELAQERRLSVHEAAYAWAVSKFIVHFSGTVGPAFGAIEKMVKNFGTATHLSHQELYELRTRLKLPPFSEDTVLKVVDSHPDMIKRLYEEFQEMHHPRAYAERGHVLKEWEEETPLKRDILCLDSPDAPPILLKFRLFNKHIVRTNFWKDVKQALSFRMDTSFLPEADYPERPYAILFTVGMNFTGFHARFADVARGGVRVVQSFTTQSYQRNRDTAFDEVYKLASTQNLKNKDIPEGGSKGVILLSKTDSRDEADALTKSAFKAYIDSMLDVLLADPRVVDRLGKEEVYFLGPDEHTGTGGLMDWAAMRAKERNAWFWKAFTTGKLPAMGGIPHDTYGMTTASIETYIQGILEKKNLKEEEVTRQLIGGPDGDLGSNALLKSNTKTTSIVDGSGVLHDPEGLDINELRRLAKRRFEGLKTSAMLYDEKLLSPMGFKVSQDARDVVLPDGTAVASGFEFRGRFHLDPRGSADLFNPCGGRPASVTPFNVDKMCDEKGKPRFKFIVEGANVFITDEARRMLEERGVILFKDASTNKGGVTSSSHEVLAALAMTDEEFAKHMQVTDANNPPAFYQLYVKQVMDRIRENARLEFNALWEESLRTGKPRCDLTDVLSAKILRLNQDIHKSDSLWQDDDLVSRVLLKALPDVLVPGLMSIETLRQRVPESYLQAIFQCFLASRFYYSQQFTDDLSTFAFFDYVRHLKNQPLPESVTAKRQDN

SEQ ID NO: 197 - protein, 1084 aa, Neospora caninum
MANDEDKKLVTIQAAAKDPAQTGKEGKKEKDGDKKKKVDDELTEEDKKIKEDIELLVERLQDPEPGVVALALQTLSIQLKAATSSMTSVPKPLKFLRPHIPVLIDHYHRLAADDAIKPDFAMVLAVLCTTCGDGQRRSLHFCLEGGCKDIASWGFEFLRNLAGEVAAAYAEIHGEEKKAGAVEEDLLAESSAEQRESASTSADRPSGDKAQEAKDAEAKDAGEAKTAPSGKKTSMALQISMEVPLPTLAQLNQVVDLIVPYYMAHNAECDAIDLLSEVERIESVAAHVDGNNFPRVTLYLLAMANYAASLDEYSRFLTVAFTILFDQKQWFDAMRVALKLPNAATGENEKIKAVVEHCRADDPLMVKQLALLLGRQGVDFDFEDEQTQRLNSGEELSNFFLLLAKEMDVLEPKAPEDVYKTHLEDPASSRRGATGALDSAKQNLASTFVNAFVNAGSCKDKLMLADGGSWLYKNKDHGMISAAASLGAILLWNVDEGLSHLDKYQYSSDANIKAGALLGFGVLSSNVRHECDAAFALLKDHLEDSAEGGRSAPCQKVGAVVGLGCAHAGTKREDVMEAVTVVIVDSSLPVECSAFAAVSLGLVFVGSCNQEAAEAILTTLIDRSSVEKGLDSPLCCYFALGLGLLFLGAREACEPTLTALEALASAAPASEPQQLRACLLAAYAQRTVEGLAYAGSGDVLKAQKFLSVCSETRDKQYWSALLGPKTGEEGEGEKEEKDKATKETDAAAAQSRNPEGSAEDDDEEDGRKLDQAVAVMNLALLAFAEDVGAEMSLRMLDHLLQYADLPQRRAVPLALALHSPSRAKQGIIDTLSKLSHDVDAEVALNAIFAMGVVGAGTNNARIAGLLRSLASFYGRDGNALFVIRLAQGLLYMGKGLLTINPVHSDRFLVNNVALGCLCVIMHTCLHMRTTILGKYHYLLYYLFPAMQPRMLFTVAPMSQLPQAPSSSTEGASASPEETGGAAGTSGTPEAPEEAMGEEKEVDLSEEELRMACLSARVGEAVDIVGQVGRQPKTITAFQTHTTPVLLSYSERAELATDEYVPLAKVLEGVVIVKKNPDFKPAKTA

SEQ ID NO: 198 - protein, 1037 aa, Neospora caninum
MDGANLYDEFGNYIGPELGEDEESEGEEEEVDRPLPVVGEEDTDHSVAVRGLVSMGEEEEPPSAAVVPHELKKYYPDHAEVYPEADTVVQEEDTQPITQPIIAPVSTADFDLLEKQLPVTSFSFDYLASLMFQPESIRSVCLLGHLHSGKTTFLDMLVEETHRPPHNSRRSAPARMAKRYTDSRKDEQQRALSIKASPMSLVLQSSRYKNYLFNIFDTPGHVNFNDECSAAMRLCDGAIIVIDALEGVMSNTDRLLRHAVEEQLNIVVVINKLDRLILELRLPPADAYHKIRHTLEEVETETEAKARGEEEERAGSPRRGAGGGVNSILEQVCEVRGREPIVISPLNNNVLFAMGQFGLVFSTRSFAKLHIDSYRPDKKAHGPRMPGEPASVEALRTPFPSVEVFEQALWGDLWIHPETRKVVDKPPFSDAPRTFVEFIVEPLYKLVAHVVAEEQPTLQPTLEELGIYLKKDDYKLDSRTLLKKVLSQFFGDASALVDTVVEAVQDPKTNAPKKTKQLYTGNQEGRVAEDMKALDSESDVLMIYSTKNYHRPNNFHSFDVLGRVMSGTVYKGQRVKVLGEAFSLDDDEDMVIRDISHLWVLEGRYRVEVSHVPAGNWVLIGGVDISVLKTSTITNVDHSEEVEIFSPLLFNSVPVIKVACEPLQPSELPKMLEALRRIDKSYPISRTRVEESGEHVILGTGEIYLDCVLHDLRKLYGDLELKVADPVVQFCETVVETSALKCFAETPNKKNKIYMLAEPLDKQIGEDIEKGLVSDKWETRVLGEHFTTKYGWDVLAARSIWAFGPDARGPNVLVDDTLPSEVDKTLLGNVRESIVQGFQWATREGPLIEENIRNVKFKILDASIAADPLQRGGGQVIPTARRVAYSALLLATPRLMEPVFFTEIQCPADCVSAIYTVLARRRGNVSRDMPKPGTPLYIVHAYLPAIESFGFETDLRTHTCGQAFCLSMFDHWAIVPGDPLDKAILLRPLEPAPAPHLAREFLLKTRRRKGLSEDVSIAKFFDDPMLVNIATDLQQFL

SEQ ID NO: 199 - protein, 1938 aa, Neospora caninum
MATNEAGAPEEDAGGPNCVPETGDSLAAHVPPFPQSLARLESCRCVTNADGHHFLLCEEEENIDILRQSSSSFYPTNPEGVFVLHSPLLSSHLSATACSSSVSDPKSNAGPRRVVAVSIPLAVSKSEREARELLKTHLPEWEAALHAFLSGKEESASSADIAVDKKPREKMSSPELDVRPDGGADPTSGTADSHLAQASVAPNAPPLAPPAPLATDEARPAGGDARGGEDASETVPVASEQSAAGFAAPGVLTKEEPRGDEHEVTDLSTNGRTAKEEHGVPAASSGLGASSLAASDSTAGASANPLPSTEKTQGASNAKGVDSHASIASPSSGAASNGAPPKSPGHALPASSGQLAGGGPQASPGTPSRTPSAAGEASRRGGATLAPASAPPPRRPTLFNLLDALAHDSVTTPDQRNCIRSVVTDFLNHSLPHAKVYTFIGAIVGHDVLHAMVRKLEEQPSRLGAPDQGGLTRIEKAFGLTKTSGAVAGGAAGPAGAGSGTGAAGRLASKCEEEKNQVKNAVLGEANYFQNSGQHARTGGRSHAASGLHGVSGVGPSGATGSAHGPGERDSPLAAVARHAAAATQAQGDGAGRDSRVVVGQSRDEVVKAMRRNLEARRQVQGSVDVFDRVKWLPVRRALTPVPVFGHSLVTFSNTAVLFGGSNTEGAVSFRHVFVVNTNDFSVRGFPMGGDPPCERDGHTTTGLTTAAGPAVILFGGCSQDSFLNDVYMLEVDPKRWVRRHPVGKAPQPRDQHVAAVFPARTETGVCRENSQEVLSEFLFIFGGRIGCPEAYQATNDMWTLHLATDTWTQVLLEGSRLRPPPRFGCCGVWSNDLFLTVFGGETTAPAHGCALARDADRAEDDGDAERALPRLLLDDMWHFKILDVVGAGPDARHARGAHIVGEWTQEKYEGAVAPRSHYSAIFITQRYQEPRAEPRTVERLMLITSGLTYEQDSQRSSGGLNAMPRQDAKLEAAKPRKVVETDKITVYFFSRKKWFTLKPRYPADYVYDLCGARQRHVACFFEAQPLTQRAPRPPVPCLLIHGGFRGKQVLNDAWVLSLTGEDPYRGALFASANRGANAGFGAPSAFAPSSLSSSALQQLAMGRSMLSLRMYPSYYIRETHSPGILWALCGQQRWAFGAISQLVENSLSPVVTSRNVYVTWEESPEKEPMLAIQDDGQGVDYPAMNALLRLFGTFEPGDRMRKSYEYGVGFKIAFGRLSSSCAVMSRTQGTIGVGMLSMELMGHCDAREIVAPMCMWRLPNKELINRDPNNAADHRHHQRLLMSYTPFTTPNLLAEQINLLGTVPGTRLVFWDLRDDLDFLVFDPAEGTLFLNTAPAGERGRKGEAGKAAEGFDVHGAEKAAPVDLPLGKGRQEDITRPRLDADDGPSPAGGPELLDLDEDGQPLPARGGKETGVSEDEKARGPGDAASSAGDGKEATPPGEESAKSGEKRGRLQGSLPPLFPLWTCARHSPDYCLPTYLFWFHLHSPAQLHVQGVPLLPTPASLAKIVEQEACKSEEKRDGAEAHAGQEGAELLQEKDGETRGDEEEEKRKEAREKHEKEELAESPGPGRSLYFFLKERLYCQAELQYLFTPADHATGCFALFGFLNDPCAPLAPGPSAAPRVCEAGVLLYFRQRLIRRLDAAFPDYPKALNAACEPADDSLFGGKDGTGSAEMFKYCLTAVVHVPEWMLPSMTKQDFRHENNLPFMKFKSRLLKLIDEYLRRCRNPQALQAWLEDRARRLREYHEELRRSRPKRRLGEDFTDEERPRRSPTPPVTHSSSGAPIWTGERGSGAAVSLPPVKQRAVARPGAGSSGSWTEERGSEREGEERKEVSAETSKEERMDEGEDRTTPASELEGAQPGGEREKFAEAGSEGASGTGVSSVVDSGDMVAETAGAVPVAGAGDSSGSGTTGALEPNAVVDSEGLSGAGEQALETDV

SEQ ID NO: 200 - protein, 330 aa, Neospora caninum
MDGDFGATGGGFGDMADFTSSHDIALNPPALSPDAVSPFSSRSPRRDQSRQPQLSSGSGGYEDGSSSMYSQNDNGFLNGVRNSSQDDDSFFAGEQRADDSFLEENDVFVVDRGNRDREMGAGGYAPPALHTEGEAGQKRDMRFDEEVLGSQGQVNGVYGLAKERSPREGKQEEVPQETPTQQGPRMISGNLETEVDERVRQAAEAMQEQMRQEVEGRRKEEEALKREQRDLAQEELKDFYERRKQLIDRRSKANQAKENETPNGFSSAREGSWSRVVQLIDADDKVRSRVGSSAGTATSGSAASASSSKDRCKMRDLLMELSAQEKEESH

SEQ ID NO: 201 - protein, 460 aa, Neospora caninum
MDPRGPVGPAAAGPMRPGFPPQQMMRPQGVPPQGAFPAGPRGPAGPPLGGPNMGPGVPPMGPGGVPMNQPRGPGGVPMNQPRGPGGPPPPGVRGPMPGGMMPPQGPPGAAPPPGARPGMPPPTGMPMRPDDRFRMSPPAPGAPAGMPGTGMPPQGLPRVPAGQLGGGTGGMPAAPEARHPVPDLKSQRGANQKDLTSRRSRDVRKLEDDERSDQQFGEEVANKGLQTFSRLVVLNDVGDLGAWNGYTWKSKRPPSEFFIKITHDSDGRLWAITENYEVGKLTANGFKTLGHIGHEDVVDITFDPKDNSMWAINRVGELLHWVGYTWDKKYHVGFHKLKALAFDRKGNLWVINTAGEIAMWDEDQQQWDLKEVPGAARLHTLAFDENNKMWVVGNHSELMLLAGNRWVVYGWVGCWKFKDIAFRWSKAAIENLRSTRATGTVFRSSNSNALPGVLSQPQLA

SEQ ID NO: 202 - protein, 190 aa, Neospora caninum
MKSVYASETITIPAGVTVDVKSRVVTVKGKYGEITRAFRHLPVDIQKTKSGNRLKVEMWYGTCRDLSCIRTLCSHIKNMFTGVMKKFQYKMRFVYAHFPINVNISANGSVVEIRNFLGEKRVRIVKMLPGVKCEKATNVKDEIALTGTDVELVSRSAALIHQSTLVRRKDIRKFLDGIYVSETSTVEQDA

SEQ ID NO: 203 - protein, 469 aa, Neospora caninum
MAPPRPTADAGATPATTVAPAAVRGLSASGAPSYASASGATQPHDSTQNVARLYADVNLHKPREYWDYENFVIRWGVPDGYEVVRKLGRGKYSEVFEGLRVGPPSATALAIAGVSPPGAANAPAGSLASPNSVGSSNSMVSTCSSSTAQMPLRTDSSGVGSAAAQGLQPAASASGSADARAGGFEGEKCVVKILKPVKKKKIRREVKILQNLCGGPNIIRLLDVVKDPASRTPALVFEHINNQDFKTLYPTLTDYDIRYYIFQILKALDYCHSQGIMHRDVKPHNVMIDHSKRELRLIDWGLAEFYHPGREYNVRVASRYYKGPELLADLQVYDYSLDMWSLGCMLAGMIFRKEPFFYGHDNCDQLVKIAKVLGTDSLFDYLEKYNLELESHFTSLLGKHTRKPWSRFVNSENQHLACADAIDLIDKMLIYDHCERILPREAMNHPYFRPVLEEEQQKAASVSAANVKS

SEQ ID NO: 204 - protein, 909 aa, Neospora caninum
MTTLRSEPMLRGTLVLPSALPLARGCLDALGRHGIVHFVDMNAHSLTRQFNTYIQRIDEMERIIRFLEDEVNRLQDAGAKIIIGPEGAQNFLDNDKSYQLDKVEEALNRLHAQFVRFKSNNADLIQQKNAALEEKCVMKTAVQQLQGSSVKDGFSAGAQNSAADGTAAGNSEEEVAKALLKQEDNKDVTPTADDPEGGLTKAEGGTSGSSVSTVAGMVATSAIGRFQRMLFRTTRGNAFCFFQSTAEKLVDSQTGNEVEKGVFVIYYQGAVHSLLHEKIVKVCAAFDAKPYEWPHSAEEAATRLAALESLLEDKERALAAYEKYFLGEISLLLEVTRPGGSSLLEEWKMFCQKEKAVYATLNQFQGRDMTLRCDCWIPRDKEEEVRSILKEVSADPSGDEQASAFLLVEKGRPAAMPPTYFKTTEFTEPSQVMVDTYGIPRYQEANPAVLTTITFPFLFGVMYGDIGHGLCVMLMGLWLVCRAKALKQDRSSAFHSAVKYRYMVFLMGFFAFFGGFMYNDWFSLGLDIFGSRWTLKGGELGTSSITMRKKDGEFPYPFGFDPAWKGATNELLFTNSFKMKFSVIVGFVQMFAGVLLKGSNAIFFEEPLDFVFEFIPQVFFICALVGYMDFLILYKWATPADRNKPNLINTIIDMCMLSDVKPEDELFSNQQTVERVLFFLMVLSIPLMLIPKPLILCSRLKKSLPHGTEKERLSSGKTNSSTIELEHAPNTGANGAGMVGVLGEGGNEIQEVEAGLRKQGTADEKEGNELGSNKETIEEHEGPGDIFIHQMIETIEFILGTISNTASYLRLWALSLAHQQLALVFYTQTVVRAIELTDNVSLVAVALFFIFAAYACITFAVILCMDFLEVSLHALRLQWVEFQNKFFKGDGYKFAPLYFIKLLQGEDDA

SEQ ID NO: 205 - protein, 569 aa, Neospora caninum
MKVAEGGVPEVLQRGAQQDKGETARLQYFVGAIAVGELVKSTLGPKGLDKILTPMQAVDGSRNGKTIITNDGATILKSVWLDNPAAKILADVALQQDAVCGDGTTGVVVLASELLKQAEELVNQNIHPQIITTGYRKALSVARQRLQQISFGCEEDRLRDYLMNVARTTLSSKLLTHEKEHFAKIAVDAILRLKEHASSLELVHIIKKPGGCLRDSFLDEGFILEKRIGTYHPKVQEDCRVMVANTPMDTDKIKIYGARVSVDSFEAVQALELAEKEKMKQKVDKIAAYGCNVFINRQLIYNYPEQIFQDHKVIAIEHADFDGMERLAAALGAEIISTFDAPDPSKLGYCKKLEEIMIGEDKVIRFSGCKRGEACTIVLRGGSEHGLEEAERSLHDALAILSQLVLEQKGEKQSGLDTSAFLKVDGKTGSAAPFPDPTGAQPLVVCGGGAAELAMASAVEELARTEEGKVSLAIEAFAKALRQIPTIILENGGLDSADIVSRLRVAHLRGEHTMGVDMDTGSVADMKTKGVLEAYKSKLSQICFAAEAAEMIVRVDDIIRCAPRERSGM

SEQ ID NO: 206 - protein, 401 aa, Neospora caninum
MATHACVVRRKADAACFAKLSASQSCLTAKSVNRSVSVFALLFGVVLAVGVSGAPFKSENEKFTCLPKQGNADQWVALVYDSQHSITFACDGGTPLPSKLLSEDDGLIVCNESDGEDECEKNAAPLSTFLPGAKKEWVTGTLQQGIKITIPDEHYPATSKAFRVGCKAGKNVCLLNVYVQSRESEVIGQVAHCAYSSNVRLRPITVNPENNGVTLICGPDGKAFPDDYMNHHCTELDECKERPYSAVFPGFSSSFWTGEASGVAGATLTIPKDQFPSTAQTIYLGCTGHPDDKQVTCVVPVNIEEVAKPAGAGSNPGGGSQPDQSSEKRDGEQVNKGKPPTGGSGGATTGKQNASQNAKDKGETGGENGDSPVLRGDACDELPSYVALSAASLTATAIFAY

SEQ ID NO: 207 - protein, 250 aa, Neospora caninum
MLGSPADGAALVTVALKKQQVCRENRRQTRRFATCLAAGVCVVSLIALSVFAAAAPATPPPAVKELTDASFEHDTQASTGATTGHWFVKFYAPWCGHCKAMANAWEDLAKELSGKINVAKLDATSNSITAKRFKIQGFPTLYYLANGKMYEYRGERSVEKLKAFAEGGWKSVEGETIPSPLTTLDVLKDELISAFLQLQGIVYHAPLPFFLLFFIGMFSGILLTCLCNLCCSKKEQKRSAVASRSIKKKD

SEQ ID NO: 208 - protein, 357 aa, Neospora caninum
MFACPCSSGPAGLAKRSAPGRILFLVWFLVLSVLLVTGNNVSLVEAKKRNVTKKYFGTLESTGPNSYRCSPQEVAEEVVGAVVLSVKAPEMSIECREGGEFMPLDGAKRYPRVCSVSATDKTDCDRNSQLLTEYLPKAQDLWYTETFVDDNATYKFKIPSDGFPPQKQQFKVGCRYTGNEYCFITVTVEPAAAVVTRQKATCGYSEAEPVNLELSMSEDNNSIAIQCGENHFPQPSTYSLQYCSGQSVDPQHCVAQHMTKLFTNFSTKWWKGKPNSPAGTVFTIPEGEFPTKPTTFLVGCSSTVDAGPFCNVRVNVAARSQEAVGAERPSGTLVSSASAPGIAFLSLVIVVGLHTVA

SEQ ID NO: 209 - protein, 186 aa, Neospora caninum
MSLQLQKRLAASILKCGRRRIWMDPNEASDISMANSRFSIRKLVKDNLIIRKAVAVHSRYRVRLYHEAKRAGRHMGKGKRKGTREARLPAKVLWMRRQRVLRRLLKKYRDNKKIDKHMYHSMYMRCKGNQFKNKRVLIEAIHNEKNLKLKEKALQEQLEARKSKAAAQKEKRRLKELKKDAEAMSA

SEQ ID NO: 210 - protein, 592 aa, Neospora caninum
MKGVAWRGGVTPNLRDCLWNSVAGAVVSIGNSWRLRLRLLGIVVIIITTFILIQDSANAQVGVLLPFGQGDEGPHILSIESLETAGSQPSQEESTGAVQDLAGSDSEEGQTDSQYIVDSKSNNVKQDSGSEGHHSVVTDQVAEEPEGISRTKDGPIGDTQVRDHSGGEGGGSAVTDEVAEESEIMTRTQDGPIGDTHVYDQSGGEGGDPAVPDGVAEESEGMIRTRDGPIGDTHVHDQSGDEGDGSAVTDEVAEESEVMTRTQDGPIGVTHVYDQSGGEDGGISVSEEGEEDSKGSLQGAKRTDTDFDVVLTTAEALARTGVQTSTEGGGVIFPVFSDVAKVRSMGQEPVGNQEAKARESTLKSRGFIVPVADMFAAVRRDWSELPIDCGVCTIGAGYLPVRLIATEKHKDGEILRFADVEYPSLVARGTLVSIPAAWLIMKGNTPKEWSPGAGGFILCLESGDKPVFVAWRTGLFSQYTEFRAQPFRERVSVVQSEVIRGTRQNESVLEAKLTLSSRGYFVNRPLNRDDYTFMFFGTVKGPPVVQSLLVKHALNMSDKCVIEREIDGGPVSLDCKGWRKFEKLMSPSTCAG

SEQ ID NO: 211 - protein, 2981 aa, Neospora caninum
MARDRWAVTGLWFVALLLLAFVDRNACSSDAQSSASPAPRSASVSFPVEGSPVSRVSAPGEDAVSAASFEPPFRLVAIAPPSDKSGPVPVLRGKQPVAAVFSVPVIPLGASLFRGDASSDSHVPAFHIFTNSAAQTVKGRGGWVTTSVYRFDPEDAWPADLTVRVHLNRFLRSASGQRLAEDCDGAGTRGAGALDGRNEAENGADRKGQANEAHGRGEDPALSSTKSADGPSCIFRLRTETLRVSVASVTSDLASAVTDKQWKPILANSSDPLASLFEVPGDGRVTVKMNSPVALSALRKMSLSDRLLAVGREERNGEFSFVPFDVRACSENGAKDAFASRDSSEDSEEATRWSDDSGEDDQDNAGGNRQSDEVMCVELSFSERPLQTRAIYELFVKKGTNYSRFSGPLGSSSVSASPPASPARHFAFFRSVRVSPAFIDPALYAAVSGSRRAKGKGSFTGPRPFRLVGSQRPLNSVSYRRVALVLPHGLSGPVGEQAGVKTEEPRASSSRSPSRLASANSATDLHEQAEKLVRRMKLVHLATGHELSIRPVLEKKVHLILWCDELLPGETYKLSVVGNADAASENLFDGFGLPLESSEIEFSMSRLRPNLEFLRCQETVWVLNDRGAEATRDKGLPLALMTIAHDKREEGERRKITWGDIDAATLDAEPFGACVRSGDAKCVARMLPMWSHAAGPMTRHPAHELVSFDGASGAAAANSSPLLSTGAFATIVAPHLSGFSPHALYLVSAHTQHFGSTSVSSDRHLVGALSLSVFHSVHVEQATNSLVVSFQVLSLKTAQPLADATIRVFASYVGYGREPALLACAPNASDGEDASGARSNAGAQECTFVQTDAKGFAAWQSSEAIVEGAELFATVVAPLSDGSTRSKRESEELPAVFVTERLSWPWELHRNQLLGAGMARSGSHPSVLVGYDRRFFVSSNSLRFFVLADRTSFRPGDKVFLHGLVSLVNSSLCGFDGACFLHQALRLDAPEKLRVLIGAQWNLEAASHYEGREVRAAHGMEAGRMGSGLAHSCSVRVVALNHFGAFEASLDIPLDAELGTSTFLEFRIFKDGDVDEKALLAESVCPDTWYQLADANNLKRLDPAEGFSILVEDPRPPSLLVSPLDLPAVVNPASSFAVSGIVKTYGGLPVQGHRVEIRFAFQPTLGEQTLRKGVARLRRALGREAQVAGPASDFSTFRVSSKQDDVKVVTAGEVSSRDTVKLHAEVRTDAAGQFALPLFLEKLTVSPATSVPLDLEHAPTFPLLWGEGTEISVSVRVVGLTGDVLPPQTASVIVASSDFFLGEHLSLSVRPVLPGVPFAVSAVSKPYPGVKAGASLPRGSSLEVAVLRVDPANPLGRSWEAQADNWTSWHTDQGLAPCQPSLFSAARDWDAVRSADARESAQAHDGDQEELDAMEAFTDGSVDLWEFVEKQRSRFSVVKSCQGHGGRLTCPVTLPLDAAQYVFLTTFRLPDGRSVRNCEYFLPTAGNLLTRALKPDLRLDSPEVTPGQRVSLVLPAVFRPGSAIRPRLVAEAERGGRGGATPPLYGSLSVWWGTRSNTRLFFPVPLDSLKDELRIPIGRVPEDCPSSCLLRVVFVPPLSETPLPISQVDTSTNALLPRTERFPLETEAGAKFGPFVVDETFTVAVRAAASPFAIPDSTVSFSLDGKAPADGEASLRPGKKATLRLSLSTNAEQKAGLASLFSKLSSRKQVRAYALVALVDKRYFDLGPMGLPKIEEELRQTVMQQDARHSVSSSFAEATAPATYLYLFGFMKALKERDPWITDLHWPSAGALAGAKELTSPWQPWSKTLRSVLLRKRSTLTGSFSAFPRGENFVDGAVFADMTVEAAAAPMLGLAAAPRMAKATFAGRQAAVEQDAGAGVASSASPAVASTKLLLSDTPVILWKTVELTEDTRGDLTGHVSVRVPDDSNTYLFRSQVVVAVEEKEGTAVSFFRRLWNRRVPASPLSRVFYGQFEKEVSVKKRLKMTPFRPKLLRKGDVANVGVILQVDESLVAEGGEAIVYTWFPERGETMETGHRQRVQLTNTALPVTVRVDTDEQSVITNHKLLQVHCFAHLAVNSSVSHGLAFFVPVTPIAPRLSLSSIWAIVAPRTLGRARDPSEAADEAQNSVVAVEGVELPLPVMEGVGGLSASVGVGYGAVLLEKIRTFLSAEVCPFVPAKQAFDDLLWDTNSKGRETVTGSKAVFCTCCREAFPASPVPFFERTSPSLSSLLLAILARQLVTAMKLQVRGELEASAVFAETKLSEYVPPDAGVFRRTGFLSRPYAEYTALAIREHPLDVDLNLLVLLVAKRHASAAVLPYVASVKQTILAFLRESESRFLASFDAVPSPGEVWPQPAPLAASEPGQAVPDSSLAHASASVGHVAQSPQKPIDFSRFLAYVGRGLVARVRYVFGPAATFNLEHPEAEEALSFSSLLRGVLSVDGERGADEKEPTNELQVSPHLLWALVIGLENRDQASAPYLLALANAVLKKSVSLLRFLPNSGAYLSGFGSATAASDAQHAMLLQTASFVLSATPAGRSASAVLLSLEPEFSAFTSFAQLPPEDIIHIFSKVVLYLARGGKRGQLGPRRMVPWTGCLFRSPWEDLLVMDAFSSWHAATQSDRADLAVSVHLGTGEREAGPVGQRATPWLLLLHGHLNLRKHTAILETKLAWSELEASKLLGGKLSFVSCRARERREAAPPESHEGERTWEGKVRVNVKGQGVAVVAIGMDFIPDRPRMLPTFMGALLQKEFLVFDSATETCGNTPVASAVRGSRVCVALRITVKDEVRDVTIRDLLPAGLELSSRDPSMSPLAAVEDVSSSCTRPPHRGFLPGRGRGSGYSSFSSFWFFPRCEPRLLGNAVEWRCPFLAPGTHTLRVVAIATVSGFFAVPMATVEVGVDLGTDMLSRRQPGGKVTLLGASGAAKRAFVVLEEDERQLATNEAALFKEAGFAPPPAWLLGSAPKGCGVCPAGTVCSPALGKCVS

SEQ ID NO: 212 - protein, 123 aa, Neospora caninum
MSGKGPAQKSQAAKKTAGKSLGPRYRRRKRTESFALYIYKVLKQVHPETGVSKKSMSIMNSFINDIFDRLADEAVRLIRYNKKRTLSSREIQTAVRLLLPGELSKHAVSEGTKAVTKYTTSGA

SEQ ID NO: 213 - protein, 157 aa, Neospora caninum
MPTSFGKRARTRQKFSKAFRRHGMPAVSRLLVIHKKGDYVDIVCDPSIQKGMPYSYYHGRTGIVFNVTQRAVGVEVNKVVGNRVIKKRIHVRLEHVRKSRCNEQFLRRVKENDAAHHEAHLKGESIKTKRQVEGPKPGCFVSGPMEVLEPAPFVESY

SEQ ID NO: 214 - protein, 145 aa, Neospora caninum
MAPKEKKTKEQIAAAAAAGSRKNKKLGMTFNDRSDLPLLRTRGAGRRLRTLFADNPTLTTLSKWSKGKSKDKLNHSVLFDKATYDKLLADIPKARLITPYTVCERLKVNASLARQAIRFLKEQGLIKIVGEHHHTQYIYTRNTSA

SEQ ID NO: 215 - protein, 274 aa, Neospora caninum
MGQKLTVEERRNIKREVYMLYPGLEQQLEMAFTCHDLQHEGKLPYTTLEPIIRHLLMQYGLIEYVTRFSDSAGCLDANQVRAELNEFNVNTSGLCCGSSLTLEDFKSLAVIWLRKILDSHADDQAVWMSKLKAEQEEQAEAYTRAMREFQETFTQQHALYQQGLQEQQKQISDWNKLLEDAQKTQQHIYEQEMRRMEEARQKEASAAEEAMKEQMDLISQYKEKLEKIAAADKSGKCFVYPAAATPYGACASAGAQEPTRRRRVKKEHQSRACC

SEQ ID NO: 216 - protein, 328 aa, Neospora caninum
MAADKQAKLSLQEDSIAKMLICKAHIGTKNVEHKMRPYVFKSTSEGIHLINLAKTWEKILMAARVIVAIENPADVLVISARPYGSRAVLKFSQYVGAQAIAGRWTPGMLTNQITQKFMEPRLLIVTDPRTDAQAVRESAYANVPVIALCDTDSPLEHVDICIPCNNKGKESIALMYWLLAREVLYLRGELPSRSVPWDVMVDMFLWRDPEEFERKERLEDEEVAPHTAQADATQWGADAAAADWKQAGADWTGPVAGGAAGEWDQSAVAAEGEWGGGRPGVAVGEPCASWLAWKKLSTSHWQLQSRGEPQLALRVAFGSCEARTSCVS

SEQ ID NO: 217 - protein, 708 aa, Neospora caninum
MRPRVSANTATVLGTGLLLCLEGTSFFSMSPLSSLPSVLPAQGLNANQRLQQGVMTQAGNGIQSADDDVVAPIFPVSECTYPAENNFEKIITTARLTAFLEKAAPGFSYRGVTHPSEAAAQIHKDISCAVQADSRFASFCNSNEKYSNEENAFVNASECAAFLAHVFVHTNSFLQFEEASNSRECRDSDKYPCGPSTASYHGRGALKVRGNEEYGRLSDYLFEDSAKLLMHPSLIEPQGVSGWVAALWKWMEQRPYGLNCPETLLGSGKASCHDAMLNQDVSPEFTMEALKDNDGEKLTKGLSGFGLTINILAGESVACCPSALKSAVGTVPKPVLVAAGASPAERAREEASQDLLLKLAVRGSGLDAGALTPEELKQLLTHQGTGQGSAGPQTTEHSEESGLQDSEAGQEGTHEKQKMQNPQGEPAPLGTQQREQQLFDQIMSAPAPPPAANEVPTRPKSDVFLQTTDSLSLPSAPSAVARFVMPPKNIFPGGNSAAQSPLSAAAATSAFLDFLAHVLYPHPTPNGTGEAVPLPSSTVPPTPFPLPGDGSRLCTARGVLSARAAESSAADTDAAGAATATDTFCLSVIRGCPVMFPPSAAEISADQVDEETANVVKAAAARNAAATMGADGEKCSFTCVEASNNAVENATNSGAVGSGKDATENDALSAKAHAEAVAAMKKEEFESKSFEYLPKAGVLCGYTCVSVS

SEQ ID NO: 218 - protein, 202 aa, Neospora caninum
MKPEYDYLFKLLLIGDSGVGKSCLLLRFADDTYTESYISTIGVDFKIRTIDLDGKTVKLQIWDTAGQERFRTITSSYYRGAHGIIIVYDVTDRDSFNNVKNWMMEIDKYAMEGVSKLLVGNKCDLTSKRVVSFEEGKEFADSCNMRFIETSAKNAHNVEQAFHIMASEIKARVQVNQQQSRPNANVRIGPSQPVRNVSSGCC

SEQ ID NO: 219 - protein, 361 aa, Neospora caninum
MAFSVLRVAQNGGLLRHLNPSKVSQRWSSTARVFVDKNTRVICQGLTGKQGSFHTEQCLAYGTQFVGGVNPSKKGSTWQSSDGKFSLPVFGSVKEAKEATGCDASMIFVPPPFAAKAIMDCIAEEIPLAVCITEGIPQQDMVRVKQALLSQTKTRLIGPNCPGIIKPGECKIGIMPGYIHSKGKIASNDESITTAMLIWIGQRCGDRASAHSWLNEKKTGTLTYEAVNQTTQTGLGQSTCVGIGGDPFNGTNFIDCLERFVNDPETKGIVLIGEIGGSAEEEAAAWLKEHNKEQKPVVSFIAGLTAPPGRRMGHAGAIVSGGKGTAEGKIAALEDAGVHVVRNPAAMGQKMLEVMQAAGLH

SEQ ID NO: 220 - protein, 623 aa, Neospora caninum
MKATVFVFSTLLAAISLHGRLFVAAAQGGGGVPPDANHQYYQNYQQNQYYAPAEEDTNGAQDQVPVNTYGSSDVGNGAADGAPPAAPYYASPPDQQQGYNASPPDQQQGYNASPPDQQQGYNAPPPPPQYQQQYVPQYQQRQGYVPQYSGGAPSPAQGYAQQNRPPAAQGAGYGAPPPAGQTPPAQQYRAPPQGSPQQGYQQGGARAPPPAAGAPRTPQQPPATQGYQAPRPASSTGQARPAPAGQAAPAHQQRAPPPPQQQQQRAPPPPQQQQQRAPPPPQQQQQRAPPPPQQQQQRAPPPPQQQQQRAPPPPQQQQQRAPPPPQQQQQRPSPPQPQHQQQRPSPPQPQQGRPAPAANQAGAAGTAQARGAGQRAPAQQARGAPKAEMKPAAPDDDSEDEGDVEERIRREDEGQLFDDDEEDGTSSLMEEWEKHMQNFIPEMLVTFPLAPRSDEYFYEHIDANDGAVHLRGGFFVGGDEASSAVDFSITDPDGDIIYKKSKSEGLFYFDVKKKGTYSFIVSNHQWLESRMVTFAIGRGNETALMPKHVQTAGEMVDTLQGQLRDIQAESTYLGIRQRSHAEAATALHSKLFWLAVVEFACLITTSAFHVFYIQSLVSDKRIL

SEQ ID NO: 221 - protein, 486 aa, Neospora caninum
MVQHRIKACAAYLRHLWLLAAMTAASVLVTNVAAGTAGRDRTSGYVNVGSGSDNVTFVFYGATGDLCRRKLYPTVFQLFLENKLPEAFFIVGMSNQDMSLADFRKMHRPQLEKVWSSSKQSVDPARGNLLKQFEGRMSYTSGSIDDDNVLRPFCHKISKMELLRAPNSRWGRLLYLALPPHIFAVAAAGFKRNCSAHETNEGLLILLLQIYRIDHYLGKEMLLALPPLRFTNTFLEPLLNRNYVKEIVISFNEDIGISGRGEFFDAYGIIRDVMQNHLLQLLTLVVMERPATLSDEDIRDEKVKVLKQIDPISLAETVVGQYAKSEDGSVASYLEAGKGMGKKTVYVRIKFAGVPGFRGSTYDYRGDSLILEIQPHPSVRFEINAKAPGAGLTLERDSLKMDVTTDGVRIPDAYENLLSNVLRGDKSQFVRTDELRESWRIFTPMLHQLEEQQIQPRLYAFGSPGPSGAMHELREHKATQHLLVHA

SEQ ID NO: 222 - protein, 321 aa, Neospora caninum
MSGESPLEFKGVLEGHTDCVTAISTPSLKSNTIVSSSRDHKVIVWTLNENPDDSGSVGYARRALTGHSQCVQDVVINSDAQFALSGSWDKTLRLWDLNVGVTVRSFQGHTSDVNSVAFSPDNRQIVSGSRDRTIKLWNTLAECKYTIVDDQHNDWVSCVRFSPSANKPLIVSCGWDKLVKVWNLSNCKLRTNLVGHTSVLYTVTISPDGSLCASGGKDGVAMLWDVNEGKHLYSLDSNSTINALCFSPCNYWLCAATDKSVKIWDLENKNVLSEITPEKTNRSGAPWCTSLNWSHDGRTLFVGTFTGAINVYEVSSEQVTA

SEQ ID NO: 223 - protein, 1125 aa, Neospora caninum
MRSLRSFATSRWSRDASARRASLSRAAVHRAPSASPSSLCPSLRMSPLSAALSARESLGAVLGSCASSRLLACGFSSARTASPSLSGAPLASESFLTGTSAAYVEQMYLSWKKDPTSVHASWNAYFTNVANDLPAGASFCLPPGGSASGALGSTIRGAAARAATPYISTAPGSLPAGASFVTPESLPVSSQQSVHDTSRLIQMIRGYQMRGHELAAVNPLSLPQETPFVSRARGQSPAGSLDFETYGFTKADLDKVYDCRVEGMCGFLSPELPPRPLHQIIKRLEEAYCGSIGVEYMHIGDRNVCNFIRQWIETPTKYVFSPEMKKKILARTARSQMFENFCGQKFSTSKRFGLDGCETMIVAMKAITKKAAREGVNSVVIGMPHRGRLNVLVNVLHKPMQQLLSEFLGVTSYSSAEWGNSGDVKYHLGVEFDHFDADAQRYIHMGVLANPSHLEAVDPLVIGQARAQQYYSEDEDGTKVLPVILHGDASLAGQGVVYETLQMSQLPNYRVGGTIHIVVNNQIGFTTNPVDSGSGRYCTDIAKALDAPVFHVNADDPEAVTFVSELALEYRQRFKGDVFIDLVGYRRLGHNELDMPKFTQPRMYTLIAKKKTVFDIYAEKLVKEDVVNEADLQQLKQNILAFYNAEYEKCRDFLPSQQYEYSPQWKHLVRPDVPAAPQLTGVPLDRLRELGTKIFTLPPDFNVHPTVGKIYKERLNAIQAAPDENLIDFGTAENLCYASLLSDGFHVRIAGQDVQRGTFSHRHAVLHDQTTFEPYSIFDALKCYGFPHKIQTVNSPLSEYAAMGYELGYSLEHPDSLCIWEAQFGDFANGAQIIIDQFIASGEVKWNKQTGIVVMLPHGYDGQGPEHSSGRIERILQLCDDREDVIHQENWELEKSSIIQQHNLQVIMPSTPANTFHALRRQVHREFRKPLIIFSPKRMLKMRAAMCTLNQLNEGTRFRRYIPDKIAEPEKVTRLIACSGQVYYDLIAGKDKMKNGAQNGDSPGDKIAIARMEQLSPFPFDLFIEDLKRFPNLQSVVWAQEEPMNQGAWFYTSKRIESSLRHLKYPNGIRSPIYAGRDVCAATAVGDKKLHDKELAQLLQDALDVNRTTHSYLEKYLHKQENTHK

SEQ ID NO: 224 - protein, 1998 aa, Neospora caninum
MLFLLSPTKPDISPTVSFCISSFSWPPVSYPDEALVAFPGIFAAAAAPASPEPSSSGDTEQVGGFGKKDGKGDQRLGFSAAGQNGDVTQQGLAVYDTPAGRSSPGSVTGQNAEVTISSKDSSSRASRRYADRRLPQEMTFQEWLLSALDSSVDHPPSPRKPGLGDAKKGGRALQASSAGKALSTRRRSVQVKLGQGTAAERQETRPADAADTSQLLKSLKAGLPQGAAQTGSENGDLFGAAAQPEMVIADGWDPEKQATVVHKVEAALEKRVSKLTGDINWLQTQLEGVLGDMQMYREGLHDLRPHRNVEAFEQIALGGPSLPHKALLETLENAVNVLDSRIATFVRTNSTLFESQLREAVDQRLTPLRRDMVDLSFALLNASDSSVALANELVDVSSGVNSTVARNVAEVELLQSRRQAAYEEDVRTEEFRLRNSVEELKQTEQSRINRSSLEEQILSAAVADAVHEMERNGVGVLDISEVYSGSEAKKVLELLFYMLAKQQDPSWEVLPIVFVTAPPAPLPVEPRSVNQLLRTAVAAGRPNNGDTARGAGLDTEPLWVDVTRGMSLLGGEVSDSSESASFEEFEGDHGVTTAAPAKPDAAVDKEREAWSQNEEGDESHTIDLLQRRGVGEPTTDAGADQNEGAAGDGGGKAAASARDRAHGDRKRPEGGPGAPDGQARESWKGSKGGPAEQTTQRHKGSRRGVEKEKKAGADAGQDEAQKKPGQDGRGDTRRKGTTRRPPRGERSNEVPRHGGSFFGGLFGRAKRHLQGDAKEAPRQNGAAARPSVGQENATNSLDSGRDWSVKVIYSYEGASQSVEPEDWINLSQMLPPAVIREAAVDDRARYALVPPLSTLQRLVFEHFQGRPRVRLPAADPQTGNAAVAHAPSQEAEAQTRTAETAEASDPSKPTSELADGTTEAEARMRVRRLAAGSARGRETWKKVNRETDVSKKGGYYILRVSGLVIESFYVSGDYHVSPVPTLYPVSEPVTGLGPLVSYAEYGSQFIKAYRDFQPPFPSLSPFRKNSDFEAWLGQPTLSSWAGGDGGALSRPQQTQAVPLDVEIREAGQRGAGTAPQRRARPGNAGDVEGEPGQLEAVDGLAMLARAQRVNRDGEGKTEEEASEEKRSGLYSRFNPFVCCLNESSRQLSKWCVDSNLGIFAGSVDGPDAEGETEAAAAARSRAGWEERETGTSKGSDEAQAGGSVREDSKTPTAHAAHAVSEQTGQTSGQQLPQRREDRAALFPPSVGKRKVLMVYLGPRTGGLPLRYLAGSGGELRRLQLAQRSVETLVQNLDGFCTADISYKTRQDSGETRKRGKKAKQKKQAKPEQSPSTSCTALDSFIHARVGIREWRQLMALKHEAYVSNPAAWATSYDKRMLDKYQLYVETAFAPEAPPLFLPLTSFFQENFLLIRVQVATCPSRPRGVVEFAVPPVSVLERALYLVGYPAAGQAAVAAYGYATRTQSKLTRLKETAKAAAAEAFPQYQPVLSAMQTATTEAGLWGRASGAGDASNWIGHVTVKFGKTSTSSIELIDGSLRNRHSDSNDHELPVDRQQFWKVHVAEDKRQKGSNDDPFYVKGVQAGEGEAATECDTTANIVTRMGSYMETRVVPRLYASELRGRKIVLVLSTDQHAFLGERFFAGDRIEAAWKQAHLMPTRNHTAENRYAPRWTNNKEPAVGGIVGATATYNQREEASQKTDVPEMNLADEPLSESPATQQSTAEDEQAQLSERVVSQEEATVVPQEEETVVPGDEETVMPQEQETVVPQEQETVVPQEQETVVPGDEETVMPQEEETVVPEGEETVMPQEEETAMRQDDETVVPQEEETAMPEDEATVVPQEEARAMPQDDETVVPQEEETAMPEDEATVVPREEARAMPQEEARAMPQEEARVMPQEEARAMPQEEARAIPQEEARAMPQEEARAMPQEEARAMPQEEARAMPQEETVVPEDEEAVTPEDEEAVTPEDEEAVTPEDEEAVTPEDQETVVLEDEETATPQDE

SEQ ID NO: 225 - protein, 828 aa, Neospora caninum
MKQPNPPVGGRLSPRQPWTGLYAVPVEGLPKKEGESAVYRCVESSQNAVPVKALPAVLEDFPDIRSPFDTLYCAAQAFPDDPLLGEREKLPLPEFSVSQVETNGPGASLSAKTHETRPVTASSASGNSPPVGGEKPGSSNRPLSADGEDGARLGTGGTTPVTPSKDSSTGLRSTPTAQSLGESLPRKAGCLRFGEYKWLTYKETLDQVQALAWALSHVVDVPVASFGDDSEVQETYRFVGIWARSSAAWRITDYACNAAKTVSVPLYDTLGHEALLYIMGLTKLQVLCVEGAKIQDALRLVTDEKVPLKAVICFDPVAPEEVEEFAGNSVRLYSLSDLIEKGLGQKHERPTLSVDDICTVIFTSALEKTLGKWKEMWPAKRRRGCVPEETPKRADLLRCAAGTTGVPKGVVHTNGGFVATIAGYAACNNRMNLARGDITLSYLPQSHIYQRGVEIILTHLGVRIGYYSGDITRLVEDIQSLRPTVFFGVPRVYTRMLDKILSGVKEKSGVVQWLFRKALAWKESNYKKDGSRFTATVPDLLFGKIRAIFGGRLKTLCMGSAPMKSEAIVMLQMLLGSPVCEGWGMTETGICFLQDLSDNEKGTIGGPFPSLEFKIVSLPELAYDADAAIPRGELLVRGPSVMKRYFQAPETTQAAFDKDGWMRTGDVVELLPSGAPRIIDRAKNIFKLAQGEYVAPERLENIFSSSPFVEQIYLHGDSVQNCVVAIVVPYKDVALKWAKERNMGQVLYSDLLKNSDLRQSVLYSMKEAGRGRVHGFEEPKNVFLTPHAFTAENGMATPTMKVVRKRVEKEYRKQIDQLYAELKARHAA

SEQ ID NO: 226 - protein, 2559 aa, Neospora caninum
MTEDAVRQTPPRVVAVCGKSRRRNGAFFALLAFFVVFSPFASSARPTQSGKLLPYTGAPWGKSTGTDDSRRVFVSPASLRPIFSAPLASPGPSHVGQPKGIEFGASPAAPRNPSPAISAVSAHGLRRRRPLLPFSHFRRSLAFLSGPNLSASSSTSSCSPSRSRRAPAGPPEALDSFRCHRTSLSGVESPELRQSTFLRPPSARSSLSPASLSSFSVSSSADHAGGLQTALHAATSEARVENRERVSLPRVDGDGTEGDILANYVRKHGGKRVIRRVLLANNGMAATKSIFSMRQWAYMELGDEKLLEFVVMATPEDMRANPEYIRRADKIVEVPGGPNRNNYANVDLICQIAAQEKVDAVWPGWGHASENPNLPRRLRELGITFIGPSATVMAALGDKIAANILAQTAGVPSIPWSGDSLQATLDDTGAIPREVFERATVQSAADCEKVAARIGYPIMIKASEGGGGKGIRMVDRKEQLRGAYEQVVAEVPGSPVFMMQLCTAARHIEVQILGDEDGQAVALSGRDCSTQRRFQKIFEEAPPTTVVPPHTMKEMERAAQRLTQSLGYVGAGTVEYLYNRKDNKFFFLELNPRLQVEHPVSEGITGVNLPAAQLQVAMGIPLWRIPDIRRFFGRDPNAGDRIDFMKDDYLPIERHVIASRITAENPDEGFKPTSGRVDRLEFQPLENVWGYFSVGASGGVHEYADSQFGHIFATGKNREEARKKLVLGLKRVDVRGEIRTPIEYLVELLENEDFIENRIDTSWLDKLIKQRKSLGEKKVRKAHVVLAAVLFRAIGALKEKEQRVLSALQRGQRYIHDLAALNTVSQEIVYEDQRFAFQVSRTGPQLYLLKLNAQEVECLVREQPDGSYIVLFPGEKSHKFNGREEPLGLRLQVDGSTVLLPNVFDPSELRSDVTGKVVRYLVPDKSQVNKGEPYVEVEAMKMVMTLTAGETGVLSHTKSPGSVINTGDILGTLELEDPSRVKKIVDFAGVLDLPGAKKRAGEAEGEAEREKEKGRQALSLFGSPEEEAAMRLRLAMEGYEQDVEPTVQKLAFPSGNAENLKVKKEKLTELVVELFQSFLGVDEYFASLQGSEAGVEGPAEGGKAQDPATLLKMKLAHSHLQPRIQLVLSLLRALQNFPNFFPDWTMPVSLELCLKRLSALHGRAYGQIALEAMRLLRSFRVAPFDQRVQRLKEQLLQIPALSASASEAERREAVRQAERIARSSTTSAGIDLLSHLFGDEQVGLRALEVAVRRHYRGFPIYALHTELFEVKTRDERGEKTRKVPVALWSFRQGDLTGDEAPLRTGVMGAFESLQEVQEVGDRLLARLQQFDAEKKGTGTKVRREAEGEKGETDAETEPRNVCLFALTTPINGVGAANAETEDRSSPSGEEKLKTQMEGILRTLQPSLRSADVRLAAVHVPQVKKSCRMFNFLASDGFNECRIRRDLCPTVPSLIELKSLQTSFDLTRLDALDPNTQAYLALPTVAPPAQTGASPASPAPAAVAAAPAKKRLSLAQAPQSVFVRRLIFENEVKSDLSDLPRILLDLLDVLDRCANDPRVSATASGRLFLHIVSPLNLTSAKHVTEYFQKVMKRFRSEHNERLLRLRVDQLEVKMHLRKGQGDKGRGSDREGPDADAHEREKEGLQVLRLSVSSHQGSWLHTKVAEDVPHVLTGDPIAHRRFVFSEDGEREAAAGPAEKTTHKSLESGPATGAGGTAEAEGREGKATPGSREASEAEDLPTRVSVGLKTLRGIETGASAEGGERPVASPSLSSVNWEEGDRKKQQVLSLSPGQKNEFFQHERNVEPYPEVDRIAMARSAARRAGSTYIFDFLGLLEIALLQSWEAHLKEKGGKEGGAGGWDEAVPRDLFKAEAFRLSPKGDLYLDPDWRVADNKIGMVGFLVTLKTPEYPAGRQLVLLGNDITFQGGSFGVPEHRFFTRVSRFSREQGLPRVYIACNSGARIGLYENLKDKIKVEWKDASNPSLGFKYLYLSAEDYEALPSGVVSGHFEDNGKSDSGDGRRFVLDAIIGDADKFIGVENLRGSGTIAGETSRAYDETFTLSYVTGRSVGIGAYIVRLAQRTIQMVRGPLLLTGYQALNKLLGREVYASQDQLGGPEVMFRNGVSHLVVQNDQEGMKEVLRWLSYTPKTARDSVNSANLFSVDPVERDVDFTPTRAPYDVRHMLAGYTKEDGTFVTGFFDKNSFKEYLAGWGKSVVVGRARLGGIPFGAIAVETRTTEARVPADPSSPDSRESVIMHAGQVWFPDSAYKTAQAINDFNRGENLPLIIFANWRGFSGGTRDMFEEILKFGSQIVDALRTYKQPVFIYIPPHGELRGGSWVVVDPTINLQKMEMYADENARGGVLEPPGICEIKYRAADQKALMHRVDDVLKELDRQLQDCQTASDAIDLKEKIKRRETALEPLYLSIARFYADLHDRPERMKARGVISSVVNWKKSRAFFYWRAKRRLLQDDLEARILAADPRLDFMEARAKLEGLLASRGVDISSDKAACEFLDSAQGKEVTQAIVEQSRREGAIEKIRYILSSLPESARRVTLESAASPTS

SEQ ID NO: 227 - protein, 165 aa, Neospora caninum
MRVLGSIALLAALVGGASAASFQVSFPKSIDADTVSKHKLEVGETCTIEMLPQNSKVTVEPEQLEKEAFPLNNGSCDTAKGAKPWAELFPGADKNFAFATTTSSSSLILKVPPHGDGQGFCFILRDTSTKHTTTYEVTTSGAGKTAVGVITFIGFLSSVFASMHS

SEQ ID NO: 228 - protein, 142 aa, Neospora caninum
MEPRAADVVYARGFKFTDPATRCFILNIAPGVSEMQLEKQLNKFGLVQVYTYQPATLKFPGWAWVGYYNRQGVNNLLNMSAAMQKVTAEQTFKVTSETPRDMFDKLQHDVDTVETSTTRVDTEPEAFEQHPEKQTAEEEQGP

SEQ ID NO: 229 - protein, 203 aa, Neospora caninum
MLRSCARLAAAAAAPAKAARSTAEVPDVLVTFGNQSEKITFVSHPGVMAVSKLLEMDYLTEHRAILSQENVDAIREYDEELANKAQIAVDNNIPVNFQNLEFFDRQEFVEMHKKEEALLKKAREDVLAAPRGQYTVPSYVADYSPIEIPRKYRTDLDLTEEMVKVDPALRVQAELRDIITDYLVSGKKKAAASVTGGEKKQIA

SEQ ID NO: 230 - protein, 444 aa, Neospora caninum
MKGIRGTAAGLAAPILCLLLGSSVFEADAFKVRAHEAVSMTTLSGLSTPANQALKRLLNGKDLADVAGWAHRVSDKYPDTARLHFMHQPACPSKPLRTDDIVLDKSFCRMKGNCLLEALTYFFFHLVDPDQNKVEQKDPAVMTTTNFVFPHGIKTTDADAVKYIINLIGDMHEPLHLGSTDDDYGRRVVVQYNDGEQTRLTSLYNYLEAALIDKTVKQRQYFWFSGWTHVNSVKGAYDSEKALFAKNKEKMFSEWAKENRAVLCNEVYPHVKKAKKDARAAASALGEAAVDEYARAALDAAKDVPLFEVDSAAEFALFQVLKKRILLAGARVAIVMNHILQVRESKDLGKLRQGSGVADVVDSIDPPLAVENMSMVYLKNFLTNFAIFLVILLFFVYISRFYSSPPAHSPQRGGASGSAMTKMAHVGGTPAGGKRMEMECMKDS

SEQ ID NO: 231 - protein, 1102 aa, Neospora caninum
MAPSRAAPSGAIALGLAKRSTLWTKGLKPTFLCLIFSCLIAFLGLPSAFWTFEAGVDALSVSTRASVHKDVAEISANQSDQERSSVEQPSESDAQQSVSSADLAAPEKKDDLPDKKQSPSETPEAKPEKVKAPSVSSPPSSPTPSPDTAPAATPSTTTDKSPDTSKKLNKPARSKKKDVRAVDGSLAEAVIDQLDSIKSVQVSGALLRRIWKEHQRVGEDMRDLLREYLLALERELYTQQAEIFGLEKLKMDEVIRHEHYPEARQREVELEMQALAEQHKFMKKLFSRMHANTETKSTAALVNRIEELDKPVDIVDATDKGSGADVLHGLKVVGKDIKTMRESVKKFSRELETLERLYSEQPSGEHDEIRKTLGAVMDPLAGPVSSMDYQSLSWIPKKGKVLGYVDKAYHKSMEHDDDAFLDEDDDMDVDEDHYDPFDPHDPWDVDGDGDDDDDESSETPRKKGKHGRPGKKSHLGKEKSFWKHDFGLPWEKDKSHRRHKGSSSKSSGHHSRSQSVSFYASPAEPVEEHEEDSAVSHDDSSVFPGLFFLELGSKRTVGTAADNAIDAKQRSFVQRSQHSVQIREHRATDDQDRFMNGEQPLSFLQTRGASEEAGGSEEVGSASANQQYDGEGQGSAEDGIEDESDKAGETKAEGAHGAAGKGVQQAADTEEPSSEREEENGGHDHPHESESGVGPDEKGGHDHPHESESGVGPDEKGGHDHPHESESGVGPDEKGGHDHPHESESGVGPDEKGGHDHPHESESGVGPDEKGGHDHPHESESGVGPDEKGGHDHPHESESGVGPDEKGGNESEASHTSGSKDHPRCIDILDPQKCVETTNCFHDDVYRQCFFNCTSVSLTRQSFEGIMRGCEEFRDKPSCDMMERATARLKESGTPVIYDCHWLSEGPEVSDTTPSDSKQPGDKEEKEVGKEEAAQTNGGRSVCVNRLEAPTAEKLLWGTIIAEKQRRLEELEISRNLTPDKVCVRPRELANATLHPDKPFYALGDQVKCRPGSSFMGVRRVITCHEEGIFDPQVACIPKGTLSNQQQAFMKEVEDYAEVVEAEPGWAAAGAETGSSSITASMQGIANAAHALIAVSTILTTL

SEQ ID NO: 232 - protein, 435 aa, Neospora caninum
MGAPSTVSAGVAAQSKAPLLTVCICGGGNAAHAAAAWLGQAHKNIRVNVLTRQPEKWQKEIRMETKICRWSHLGSISGKLNAVSADPAEVVPEADVCLVCAPANAHFPLLEKIRGHLKAGGIVGTVFGQGGFDWAMLKAFEPEECRKKLGGYFALQNLPWLCRTLSYGSVVELIGPKDYLNATVVPGSLAQPVRLLISLLFDMPCRLLPNFMCITLSPSNQIIHPARYYSIFHKWDGKTPMKESEIQWGLYNEFDDLAAEWLEKLSTELQAIKKALTNKFPELDLSSVLPIKERVIQHYGDDVKDTSTLQKVFATNRGYAGCKTPATPVEGGFIPAVNGRLFNEDVPFGLCVLKDIAEQMDVPTPSIDFMIDWHQKLMGKEFLKDGKLNPEMIPQTSAPRAYGLNTPEEIVAPSLMAQNITLPFAHIDMLGRLLN

SEQ ID NO: 233 - protein, 1233 aa, Neospora caninum
MPVLYHLTLQKPTAIVHALQGNFSAPRAQEVVVSRGRVLELLRPDDQGKLQAIASTEVFGIIRSIAAFRLTGANRDYLAIGSDSGRLVIVQFSAEKNEFERVHCETYGKTGIRRVVPGEYLAVDPKGRTLMVAAVERQKFVYIVNRDNKAQLTISSPLEAHKSHAICHDLCGIDMGFDNPLFASLEQNVESTDRKPATPGVTVPKGVCLWEMDLGLNHVIKKATLPVPPSAHCLIPVPGGGGADGPSGVLVCCGNFLLYKKPDHEEVSCAIPRRLETGSDRGLVVVAFAVHRMKDFFFILIQTEYGDIYKIEISHDEGVVREIVCRYFDTVPVANALCVLKSGYLFVASEFGNHLFYQFTGIGSDASDPRCSSSHPLGREAIIAFKPRPLKNLALVDELQSLSPITDLKVLDAQGTGAPQVYVLCGKGPRSALRILQHGLGVEEMADNELPGRARAVWTTKLSHQSAFDGYIIVAFEGSSLVLQIGDTVEEVTDSLFLTNVSSLLVALMYDDSFIQVHETGIRHILKSKRVNEWRTPGGRRIKAADANERQLVISLAGGELILFEVDESHTLVETARRNINVETTCMSMQAIPKGRLRASFLAVGGLDNMVRILSLEKDRNLRQLATQLLPNNATPESVCLATLTGLGAHGKDAGKSEDNGVLYLHVGLNTGVMIRSVVDPVLGTLLDQRSRFLGGRAVRFHAVTLQGQPAILALSEKSWLCYTFQHKLHCTPLNYDPLECVASFCSEQCTDGFVAIAGGSLRIFRCQRLGETFSQTLLPLSFTPRAMAALPHISATESQGAVDAAGVGPSRRAAALAIVEADHNAYDESTKAEIRRALRGIKVNQEEEEEKEETDDMQLEEKEQHDLPEDQYGTFKAGPGKWGSCIRIVNPLMAMTIDKVSLETDEAALSCCYCEMEGLPLLVVGTVTAMTLKPRKVPQASIKVFSYDDKFSLNLVHSTPVEDYPMALAPFRGMLLAGVGHKLRLYALGKKRLLKKCEYKNLPCGVAFIRVAGDRLFVGDLRESVHVMRYRLSENLFYVLADDVVPRWLTKGEVLDYHTFVAADKFDSVFICRVPSEAKQDELGDTTGLRLRGDTTYLTDKCFKLQSLLHFHIGEVVTALERATLTAGASESIIYGTIMGSIGAFSPFLTKHELDLFTHLEMVLRSEKPPLGGREHIMFRSYYHPAKNTVDGDLCESYALLPYDVQKRIAQDFEKTPADILKHLEDIRNRIL

SEQ ID NO: 234 - protein, 101 aa, Neospora caninum
MEGIAVGLKRGYVVTKKATPARPSRRPRKLSPRMSSIREIIRQVAGFAPYERRMIELLKIGTAATTKRALKFAKKRLGTHRRGKGKREELQNIVAAQRRKA

SEQ ID NO: 235 - protein, 198 aa, Neospora caninum
MALSTMNKPGPFRRLLGYGLLLGAVVLEAAFDLSAPAEAVALRRLDQKETVQALVEQHRFSNDYDQEAEYRRRRQELGSQTPEEIEEAKRKYRKQVLKEQQEDEELKKKTDAVIEELKKTAEERGLRRYAERDEDRTDDQQMDFETRQRELRNMDSATKAQLLKQRQKENEERNRVKRNSDDVMAELKQKLAARKKAM

SEQ ID NO: 236 - protein, 332 aa, Neospora caninum
MRPLFLMGHARPLTWVTFNRDGDLLFTCGKDARLAVWFSETGERIGTYDCGKGVVWNCDCTLDSKRLICASADQKIMIFDVCSGAILHEIPEGGPCKFVEWNRKPDEQNKFVVVHDAFGSQSTKAIKVDGPNGKPRRLWSQDDYASRCVQVRWGPYDQTIISCHENGDIMIWNAETGEYINEFRGHKQFITCLSFSDDRLLMLSSCSDGSAKLWETIDFKCLKTYQTDRPLNACGISPRFNKAGEERKCHVMLGGGQAAEDVTTTASGEGKFEALIYHMVYQEELGSCKGHFGPLNTLCWMPDGNGYASGGEDGYVRIYHFDEPYFTDKFEP

SEQ ID NO: 237 - protein, 418 aa, Neospora caninum
MLANKLGIQDVGDQLTGKSVLIRVDFNVPMKDGVVQDATRIKATLPTLEYALSKSPRCVVLLSHAGRPDGRVQAKYTLRPVATALQALLPQQKVIFVEDCVGPKAEEAVQAAKDGEILVMENVRFHVEEEGQGVDEQGNKIKASPEAVAKFKADLTKLGDVYINDAFGTAHRAHASMVGIDVPVRAAGLLMKKELDYFSKALECPEKPFLAILGGAKVRDKIQLIENMLDRVQMMIVAGGMAFTFKKVVDNMPIGDSLFDEEGAKIVPDIMAKAKAKGVEMLFSVDFLCADKFDNEANTQICDDKTGIPDGWMGIDVGPKTVEKATEMILRAKTLVWNGPPGVFEMPNFSKGSVAFCGAVAEATKKGCITIVGGGDTAALVEREGYGSKVSHVSTGGGASLELLEGKTLPGVAALSDK

SEQ ID NO: 238 - protein, 765 aa, Neospora caninum
MGVQREAFFGLMFAFGLCLFPREVAGGRWGLMDIFKREPKATATASDGEDTEGSAITDLMKSGGTIGAAEGCTSQLDICFLVDSSGSIGEAHYEEVKQFLHAFLSKLPIGNDEVNTSLVIFSTTVHPHWSLRANNASDKETAMQDVLTIPYHGGTTNTAAGLQTCNQMLFDYPREERQTVPKLVIAMTDGESDSDFHTVNEAKVIRERGGIITVLSVGMYVNHNECRSMCGCRNDSSPCPLYLQTEWSQLLPSISPILKEVCKTLPKDAVCSEWSEWSPCSATCGVGTQGRTRQQLSPPAPGTPTCPDCIPPMGRSCEEQGGVKENRSCDAGTCSVDAGCGTWGLWSEWSSSCGAATRQRVREGYNQPPPQGDGLLCEQQQPPVERSQTEQAQFAPCVVIPPTPPEWSAWSECTATCGGGTRHRSRNGLPPGTRSADQNTEQKPESNPWPGFDLHEQESCNNSPCPINATCGDFGEWSECSVSCGGGLSQRSRDPWNNDQQHGGKSCMQQYPNGHTEKRSCNAQPCPVDEEPGDWEEWGECNVTCGQGERTRRRGRSVILPQYGGRSIVEQNKSLPENEKILLVETETCSLPPCDASCTFPWSDWSSCEQCEAGTGTQYRNSAVKFDYRNKPCDLPTFQTQSCDCGETVPVPAPPPSEQVTPSAPYDVPERHEEREKNAGDEEPKSESEGVPVAAIAGGIVGGLILLGAAGGGAYYYFGGGKANESLAEMDFDVDSGATKVVMEEEKETLVPVDDDSDMWMGADH

SEQ ID NO: 239 - protein, 560 aa, Neospora caninum
MEWIRGGPAAEVVFQIQQTKFVIPPEVMNRSDVQGSGLALIAKNEGFKDIPPKLPKAEDGSIRLTRPLEGFELLVDHLLDLEPLRNVPLQDFASKYIALKSEMAFWQLPLEDLPFNDKVYFESAWTDERCLFPLSAPDAAALEKHADAEPTSGRRTVLTRLEKQPEEISKTFLDLGEEEARDWSFFAVEPAEVAKVARKTHKPVPGRLVLAVGPKKFFCKIPYVTDLCVHYGTLGEPEAGFAPFALLVSPTECTIVWSLGCFIHIKAAEGSNPLSAHINVIKETPSWLCVHPCLDYVLSGVKGPVPYIFCFDMPDASAVRFFPWGCLVVNKQVTLESRKKPSDISGPSASALVARLASRDESGPNEHLRRLFTFLQPDASARKRAEDPSELNPAKPVLVASVLRSKLKALKPIERIHLINMDIEEESSVTLRHGEHYDILDVRNAAGTDFEVVMAVNGGIVSRKREDFMEVRYGEPVAVVGVTGKGHLVPQGHLLIPNGAPVGEMFRSLTLVSEYIISEKTYYTFGLAQKLFEFHRSLYLGRPGSDAGGDAILSRKGSKA

SEQ ID NO: 240 - protein, 1232 aa, Neospora caninum
MAPKQVQMPLGRGMAKDSPEAKHFQRKSSVVPFGRDGTTLTNFTCWTADCPAVKADPSLVFAKCLVVGGSLDTELELEQIDPPARGTFRVAPADVFNANELIEPEEIDDIGYLPHTNVACVLDVLKSRYVRSIIYTTAEPLLVAVNPFKDLGNTTDAWIAKYRTTTKPELLPPHVFKTARAALEDLEGYKKNQSIIVSGESGAGKTEATKQIMRFFASASTEVRTTIQDTIMAGNPILEAFGNAKTIRNNNSSRFGRFMMLDVSSSGGIQHGSISNFLLEKVRVVSQEANERSYHIFYQLLKGATSDMRAKYHLRGLKDYVYLNGKSGGCYDVPGIDDKADFEEVLESLDAMQITGPTRDSVFSILSGLLLIGNVTVEGQDLQGVPDAAYLSPQSEETLREACQLLHVDDAALKKAILMKSTKVGAQIIEGVRTMDEAQMSVLSLSKNVYDKLFDWLVRQLNNLIDAPNGMPHFIGILDIFGFEVLEVNSLEQVLINITNEYLQKHFVDVVFEMETKLYQTEGVPTEALEYTDNLALVSALCGKNDSFFALLEDACLGLKSTDESSSRLLHVPDPSLSFVVMSTSTGPLDWDECRFLTSFSMGNAVPVELRASTSSRETSEVVPSSGFCGTILRRLGPSGFFFESRRDKRMKFVIRHTIADIEYTCEGMLEKNKDFLRKDAMDVIKESPDPVTKALFEGIEIEAGKIGKGTLIASKFLKNLEEMIGIMAQTEAHFIRCLKPNEEKKPLGWNASKVLNQLFSLSILEALQLRQVGYAYRRNFSEFCSHFRWLDMGLVNSDRDRKEVAQMLLEQSGIPASSWVIGKTMVFVKPDAAKELSVLQREKLLCFQPLISVLGPMWRKVLLRRKMGKIIRFLTRVEANARMHLEPEKIDLSPEERDAFLAGIARPRKPTVVKRLHTEPERKPTKVLSLSRARLSMSKELPRNYAASNEALDVDDTKSVDTEAFVRLKMKRSPNENYLRQTALARLKERRPSNVCMEEAYHVWRSVELLFREPLSDKRLQNICTVIRNDMDQHYGFFWQVIINRTPNFGMAATHIHGSLHVVEQDGMYRDGRQFLFHLIMYKTRKPRKEEIRLHERAAEKTYGICRQKDFSGVVRVMNSKVPPYMEKDVSYLIGMLFQRYQYTRDWTTFSTCIQSYLIGRYSEPFGGAWNVIAQEGAFFLSRLWTKHSRFLRVEIDFPALAEEALSEPCPACPTPVLTVVCFEACAPDRA

SEQ ID NO: 241 - protein, 548 aa, Neospora caninum
MALAIFGDRQSGQDVRTANAAAVQSIANILRSSLGPQGLDKMLVDDIGDMTITNDGATILKQLEVQHPAAKVLVELSDLQDKEVGDGTTSVVLLAAEFLRVGNQLVKEGVHPTAVIAGFKLAMKESVKYIQEHLTSRVDANNKEVLLNVATTTISSKLIGTETNHFADLVVRAILSVKMITERGDVKYPVSSINIIKTHGKSMRESTLVEGYALKAGRAAQGMPQCVKNARVALLDFNLRQHRMQLGVQIQVDNPEELEKIRQKEKDITAAKIQKILASGANVILTTQGIDDMAMKYFVEAGAIAVRRVDRKDLRRIAKITEGTVVLTMATLDGDEKFDASCLGSCEEVYEERIGDWDHLLFKGCKGGKAATVILRGANEYMLDEVDRSVHDALCAVSRALEHTHVCPGGGAVETSLSVYLENFARTLGSREQLAIAAFAESLLIIPKTLAVNAALDATELVARLRAVHAKAQGQLPDAAGNGDDELKWHGLDLVTGKTRNNMAAGVIEAAVSKTKALRFATEAAVTILRIDDLIKIAPEPERGQPDD

SEQ ID NO: 242 - protein, 542 aa, Neospora caninum
MASADVATKSGGSKPSGGKHDGMWAHDEKQKDIRRQNIIAAKAVADAVRTSLGPRGMDKMIQGPRGDVLITNDGATILNEMAVVHPVAKMMVELSKAQDVEAGDGTTSVVVLCGALLEASQQLLDRGVHPQLIASSFLEASKQSEKILQDMAVPVDLNDREKLIQIAATSLQSKVVSHNAKLLAPIAVDAVMKVLPEGGDVDTVDLNDIRVVKKLGGTVDESELVKGIVMVDQKVSKRAGGPSRIQNAKIGLIQFCLSAPKTDMENNIVIKDYTAMDRMLREERILIAKMVKQIAATGCNVLLIQKSILRDAVNDLSLDYLAKAKIMVVQNIEREDVEFISRTLGCQPVASLDHFTADKLGHADLAQDEMVAGGGHIVRITGVNAKNTVTVLLRASNNLMLDETERSLHDALCVVRCLVKRRQLLPGGGAVEAELSLRLNEWARTLPGVQQLCVRMYAEALELIPYTLAENAGLSPLEIVTDLKLKHAQGEKLVGINVRQGCVSSMVDINVLQPLLVSSSAVKLATEAVMMILKIDDIVMCR

SEQ ID NO: 243 - protein, 271 aa, Neospora caninum
MSSAVSATAPPLAAQVQALLQAPELRYDPSSLTLLCQYTEEQVVKNTYDQEACLTVLKLYLLYPQCFSVDLARKILVKGIMNLPNEDCAVFVGMLQQQPGKKEWKKVQEAIQLWEMLEKCRFKQVWEFLKEPSMADIAATPGLIDSVRRFVCDVVSLTYASLSLADLCSFLNVAPGSNEAERLLKNLGWTVEEIYVPAKEPGRPKEAVKVVRVVGAAALAATALKEGDGERSRNARDGKTSAAGQTLAVRKTVEKYMMPENLKVCMATLLK

SEQ ID NO: 244 - protein, 851 aa, Neospora caninum
MAAKKGKQTGKGQPNKAIPAPASHPESSDEEVDAFGKSAGRGPSVFTLASGKNNASSQRDGKNRQAGSGGRRTDGSPASNSTREDAVDSGDEVDAMGKRAAHVYDALRSGSHRTSPTGPATSSGGEEARKRLGKKEKGKNAPRSGKRKEKDEGFSFAVLKERLFESSTPLRSRLLRWLVNACVALAIIGVFALKAAEEYYGQDEDTGGQQTEQHLAALQLDSGATEADIRKAYRTLSVRWHPDKNPGCAGCQARFTEVAVAYESLMKALKKKKDGNDAGDQERSRGEGEESLARTSKDIIDLTSLGPNDAFYPATGRHVWTIMLHNDKDEFSEHVMEMWQETALTLGKYFKYGVINVRKNKDLTKRLPVNIKIFPAILVMANGMHPEVYPAITRPSVESIHAFIARSFPNHIASLSSASEVKAFLSASAAPGLSALAQPYKLVVVPSRSSPTVPSLLLKHAAHKYLPLFSFGYVHNLERFLADEAETKELFAALQDPPRWLTRREDTKSLVKNAPLGFTQEDLRSSLVFLLFVDEGEGVHRYVEKLSIRKSRASQSALFTQLHNLLASFQQHVHPYIYQQNAALLCRGTLEQRVYTLVRVEGPAGEGQGGDSAKATADAVLSVDEISAILQTSRERFLKEEEVAEEDEGSKDGGFHVQTVRLSLDAPALLPSLPGIPASAPFFTFWKEDLEFSRLFLLDLDGSRFLTLHDADTRGGQNGSLREAEAEKKRQRSLLAELYQLLDAQQHKSEDEEIDEKHLDFEPLPEYCDAHRFAKRCVASAAPAWYWSALYSFFDISWTNVVLLASVAALCYVGGGLSSEMVIMLVLGGSLLIGCWSHFETIFNFFSTAGR

SEQ ID NO: 245 - protein, 764 aa, Neospora caninum
MEPCVPAPARPGHLWASKRRVALTPGSSPFSQNPRPSSLSLFALLSVFSLFSLVALPPRPNSPSLHPASAISLEPSPESTAGDLPSAASSLFTEKEAPRRGRSDASKLDQQERHLARDAAGQLLPVSASSLFADEQREDENREAMHVGGASDVSSRIGRSEREQTPFFASVSQQPSASPTHVLSPTTSSSLTVTQSGRARKQEGNTCTRNSGMCREQDQRSERSIQRHRHDSASQRDGMAFASFGSSKNSFASAYSPFDEEEDGALSNLGRQMKAAVTCPAAKILLGLSGVVALGTLGIKYTRSVLRRRRRERLERPPTPFTDLLGHVLLKREAPADGAPSTVLEEATGDVLGKAGSVTALYFSGRGVEEMLQARGYQPFTPRLQAIVDGCRQRGQELNVVYLSADADSREAEKHFSEMTWYALPFDDAAGQSRIHQLYRKFRVSTLPHVVLLDQDGKVINPHAYASMIVRPGDFPWRKKSPMELLGDDFLDGEGTKLGKETLSNKVVGIYFSASWCPPCQAFTPKLVETVKGLKEQGKDVEIVFVSNDRDEKAFEEYFKRMDGFLAVPYADTTRRAMLQEALSVRSLPTLVWLSKEGEVLTKRGVPSVLEDPDGERFPWQDKDINDVSETVEGIADEPALILFMEQMDEGAKEEQEKALEDAMRVLRSQKNDGGVPPLPRLFTAKKLSPRSIALRRICRQEPAPGTGKETKGPTLTIVDLIDQSYYTYPQDDSGKILTADEIVAFVKKFRNEELERNSLAVPE

SEQ ID NO: 246 - protein, 193 aa, Neospora caninum
MAPTAAAVAKKRLRARKPKRQLYKSPAGAAKRMAKLRSSITPGTVLILLSGGHRGKRVVFLKQLSPSGLLLVTGPFKVNGVPLRRVNQRYVIATSTKVDISGVDVSSIKDEQFGASKKEKFAERKLRKKQDEGMFVQQSDNKAKQALPAQFKQLQDSVDKALLASLSKDKLLTQYLKTRFTLRGSMRPHEIKF

SEQ ID NO: 247 - protein, 386 aa, Neospora caninum
MAVRALVHVPLLFLGSLCGVAFGATTQDAVKVEILYESKCPFCFSWLKEELHPVVEQLGADVLQKANIVFDPLPFGNAKEISDGKGGFTFECQHGPTECYLNKVEACGLSIIGRENIKQWSDWLLCVEKSTAFPPDQPAVSSASALSTAEPPLLLGQRLVQQTRFALPSVSSPARSPSAAAAWFAGLSPLRQEQIRQALGSVRSSAEVPRAPDAGSVNLDETPGEKGDKAEGEEGAREEDEKTAALREDNKYEWVLCPVPTRTAFSDLLKIIVCSETPTGDKLVHAAAARTGKHDYVPWIRINGEHSVAAENSLRCGLCRAVDLAKAPVEMQDWCKQHETECMWQQGGSLEGRCYPEENPIRDEQARSLTGGGNDARLRARRQQEA

SEQ ID NO: 248 - protein, 1540 aa, Neospora caninum
MVLLLFTVLISSLVSAATVASPPPSGVWPPYLSSAPAWRTREESAVSSDSGESLRLPYFPEDEEETLPVASSFSPSLLRAQRSQLVGASLERTPLFRRAPEVQDEGPGVSWLGLTEDKSDASGGEGEDKEGESERGESEEEKSSVSESGNNEEKSESKDSETGADEPANKSEQGDKTHQAEGPGQESGDGEDSGQPQVTAESEHPGTKTSESEGENTSIRDDEKISSQSASEPASASEGTTRAVSHEEPNESATGAENQGVAASATPQAEGEEAQGSEGSEESSPSSSSPHVEAPAHAGADAQHTASGETEEKEDASNTSPSKDSETPNDGHEAKNPAEENAQAQAPEQTEGQGEQEHESQPAEGQTQEHEAQPTEGQAQEHEAQPTEGQAQEHEAQPTEGQAQEHTPEQTEGQEEHEHESQPAEGQTQEHEAQPTEGQAQEHEAQPTEGQAQEHEAQPTEGQAQEHTPEQTEGQEEHEHESQPAEGQTQEHEAQPTEGQAQEHEAQPTEGQAQEHEAQPTEGQAQELEAQPTEEQAQEHEAQPTEGQAQEHTPEQTEGQEEHEHESQSAEGQAQEHEAQPTEGQAQEHEAQPTEGQAQELEAQPTEGQAQEHTPEQTEGQEEHEHESQPAEGQTQEHEAQPTEGQAQEHEAQPTEGQAQEHEAQPTEGQAQELEAQPTEEQAQEHEAQPTEGQAQEHTPEQTEGQEEHEHESQSAEGQAQEHEAQPTEGQAQEHEAQPTEGQAQELEAQPTEGQAQEHTPEQTEGQEEHEHESQPAEGQAQEHTPEQTEGQEEHEHESQPAEGQTQEHEAQPTEGQAQEHTPEQTEGQEEHEHESQPAEGQTQEHEAQPTEGQAQEHTPEQTEGQGEQEHEAQPTEGQAQEPGMEDTAEAHEAPQPESSSEEQESPAAGVGEETQPQGQSGQEQAKPAEETPEVSETPSGEQGSVPEAETPEKQGTENGAVAPEAESASASTGVDIENATSTEPAESAAAAPVELSAPAAEEQTAGGEARESQSSEGQLEALAAEAAPTAASPAEAETPGAQSSGAAGLEPAGQEQEAATGAEDVRDGCYATRRQEVEQQANELLKVCERNENFTKVDQRFCDELFKRIDGPFTVAEVSAMLRAADAANNISRNFRFCRATPTSSPPRVRDGDTVVHAAIAASKPRVVEILLQYGAFPNVEAFPSSPEAAARTGMRPLHYVARYPTLENYESLFLLLNYGTSVNDRDVGGRTPLMIAARSSHPHSKLFAKALIERHADVNARDKAGLSALHYAAAANSHKLVKLLINRGANVTAQDMRGNTPLHYAAAFNAAKSMNALFTLADNVIKIDAPNKNGKAPIHLAAAPSSFAVVPATIVPALALELLLENHADPVARDAHGNTPLMDAVLGGYLEIVKRLLQIAKVPLDDKNMDNNTALDLARQAAEQTGDDVLTYLTSVSDKPTCPFIPRVANSIYVLSDTQFGSLMRVGDTVTYECHVGFRMLGHSTITCMTRDGAPEFVPDPPVCTPVEQGAASSLFSAPVGLATAVLLCLAPVLLIEF

SEQ ID NO: 249 - protein, 147 aa, Neospora caninum
MTTRLRKTRKRRGHVSAGYGRVGKHRKHPGGRGKAGGMHHQRINYDKYHPGYFGKVGMRHYHLLKNQYTCPTVNVDKLWSLVSPATLAKAEQSKDKAAVIDVTKSGYFKVLGKGDLPKIPVIVKARFFSRIAEKKIKAAGGACVLTG

SEQ ID NO: 250 - protein, 136 aa, Neospora caninum
MARTKQTARKSTGGKAPRKQLASKAARKSAPMSGGIKKPHRYRPGTVALREIRRYQKSTDLLIRKLPFQRLVREIAQDFKTDLRFQSSAVLALQEAAEAYLVGLFEDTNLCAIHAKRVTIMPKDIQLARRIRGERS

SEQ ID NO: 251 - protein, 275 aa, Neospora caninum
MFWCCCGGQRDASSHEVVSVPVEAHSGGGAPSDDVTTATPPSSSAGSAATRVSVAENKTEKAGVERAPIKGGVFKPPPKREQAPPPVPMTLPKSDKARRTSVPMEAELSSGAYLVYEKDTDSLYVRWSRTPVDNALAWLRPLVQVPGHKFNVNKGKEVLTKEAHNPEKYCRAWVAFLRITREFPSKCMLLENFEKTEAPQIRVLLLECPVDNPGKAVTCEMTGYGLLYDLLKNVKAVAVVPETSTLIPIGEPMEAKVFVQRGSGEGAAESLESVN

SEQ ID NO: 252 - protein, 267 aa, Neospora caninum
MAKVVCRRAATMATFAVLATALLWNFPTGSFSFVIGTKAVGSVPLAPAASSGSMCSSASSGAASVFSSRVLQAASAVGAGSLAFARTKVLSEGDPVPGCVWRVRTAAPNGEKTWADLESDAMFKNKRVVVFSLPGAFTPTCSSRHLPDFEKEYESILSLGVDEVYCLSVNDSFVMNAWASSLNVKNVKMIPDGNGCFTSRMGMLVDKTNLGFGPRSWRYAMVVRDGIIEKLMVEPEKRDDAEDDPFVASDVGSVLKYLREAADVKGA

SEQ ID NO: 253 - protein, 535 aa, Neospora caninum
MSDAGTAPALQGELSQPQERVEVVIQPIPGTAETPEADVPQASVVEGAFHGEVPYPYPPFSTGLPVPEQPADSQAAQVSEAEAAEEAADAPIARPPPQVMTALGPMPLPAEVRQKIPEKFVAKPIVEEREIYVSKKEVRERTIEVPHVHYEHKFAEIARSLKIKKLVPRVKEVVKEVPREVYKPVIEEKVIEVPQGVKYVEVPVEVPCLYPPKIVPKPKVQVIERIVETIKPVVKEKIVEVPQTVVKQIPKIKTVEVPYYVPRYVEKIIEIPYQPPDSATLPPLMVGGLPSRVSATMPTPFQMGPVPAGQLNEINLPYEARVDINVSQEHPTPGSPAASPQTGTAASVALGRPATTLVNPDRSAPAIELPDGFTWGPPPNVPPESIPGAAMPGLPGLPGGPLPGGSADGLNMPPMMITCPPEVGNVKFAGYLAEPDILTRRGVMAYQGFKKQGTFQMLFPPLAPQPGIPLDQSGSPDVRTLVSANEAMASQSRHQLIENLQQQVESEYDQKVNASVLSCTPWAHPAQEREIVYEQ

SEQ ID NO: 254 - protein, 1111 aa, Neospora caninum
MTALGKRECLCNTGFSVRTVDGNQECVAVPEAENQLKCFHPINWKSIARTYRTETGVKDAIACQKLCSRENACTHFNYHTDSHDCELKIKNGSDVVQAENVITGPKTCNSSCYKVGMGHTAPEMAKPGKMYSAYDCQSWCLDTIGCHYFTFNVETSFCYLKGAEAAGTERKYSGDVAGPKEFCRGGTEEAETESGTAGGSGGGAAAPEAEKQLKCFHPINWKSIARTYRTETGVKDAIACQKLCSRENACTHFNYHTDSHDCELKIKNGSDVVQAENVITGPKTCNSSCYKVGVGHSARDMATPGKMYSAYDCQSWCLDTIGCHYFTFNVETSTCYLKGAEAAGTERSSPSDVVGPKEFCRGGTEEAETESGTAGGSGGGAAAPEAEKQLKCFHPINWKSIARTYRTETGVKDAIACQKLCSRENACTHFNYHTDSHDCELKIKNGSDVVQAENVITGPKTCNSSCYKVGMGHTAPEMAKPGKMYSAYDCQSWCLDTIGCHYFTFNVETSTCYLKGAEAAGTERKYSGDVAGPKEFCRGGTEEAETESGTAGGSGGGAAAPEAEKQLKCFHPINWKSIARTYRTETGVKDAIACQKLCSRENACTHFNYHTDSHDCELKIKNGSDVVQAENVITGPKTCNSSCYKVGVGHSARDMATPGKMYSAYDCQSWCLDTIGCHYFTFNVETSTCYLKGAEAAGTERSSPSDVVGPKEFCRGGTEEAETESGTAGGSEGGAAAPEAEKQLKCFHPINWKSIARTYRTETGVKDAIACQKLCSRENACTHFNYHTDSHDCELKIKNGSDVVQAENVITGPKTCNSSCYKVGMGHTAPDMAKPGQMYSAYDCQSWCLDTIGCHYFTFNVETSFCYLKGAEAAGTERKYSGDVVGPKEFCRGGTEEAETESGTAGGSGGGALQPGAGENPGAGEVENGGNSEEEDLDNGENTEEGLGSVEDTEGGDNDSAGSSENDITTFDEPVPTAPKVDFIDQAIIKVSARAAPSRTQVQISECFTVSFDRMEKTVTVASGSTSHSGKMAGAPSPTGGFVSLFYHDGQNLAVVYDYQLDSGDYGNVTVKVPFAECGLDTVNILKKSDDASFEGLRAFVTRDLKRSMTA

SEQ ID NO: 255 - protein, 1032 aa, Neospora caninum
MLSASSLRSKLQNLNVDLSKFGGPSDKPQFTPYDCDKAKVLQEARAFSESPLNPKKCSQIITKILYLLSSNADPLTSAETSTLFFGVTRLFQSSDERLRRLIYMLLKELSVQTAEGFIVTSSLTKDMTSNSDRHRGNAVRVLSRIVDAAMVSQIERYLKTAIVDKNPFVASSGLVAGINLFHTAPDVVRRWVSEVQSCVFQHDKAPIVQAHALVLLHAIKSSDRLALHKSICELLQSFQRNPVAECLLIRYVKELLLQGLASHDGAAAQTYAYAAAPTLGAAGSADPAHQRLLLDYLESCLRHKHEMAMFEAARALCDLAGAAAERGDVGSVLQSYDISGALTVLQILLTSPKPVVRFAAVHVVNKLAQKPRLASVLARCNAELEPLLSDPNRSIATAALTTLLKTGHESGVERLTKQISSFTSDVPDAFKVDVVKAVLQLCLAYPNKHVTLTNFLASNLREEGSVELKTCAVEAIMTVVQQIPQAQELGLLQLCEFIEDCEYAGLCTRILAFLGEQAATTATSSKFIRFIYNRLILENAVVRAAGVDALTKIAFNCPQLRGDVLVLLEGCLSDNDDEVRDRTQLYYAALQKAVKESGEDAAHACMQADSGKDLRVSTPTTALSDDVPSVAELLSTDPPFALDPLCASLESFLETQATPKSPGDDAFPAFDFASLPSEAAWQEEQARRREALAATKATGAGSSGSHAPPQSRGAGPSGSHAYSGAPAPTADLRSDGSAFRDGYATEGGPAGAAVSSAMSRAAVEAELHRVMGGLVAPQTLGPLLLTTKGTMLTEKEAEYAVEVVKHVFAQFLVLEFRVLNTVEGQVLENVLMRVAPQQGAWAVVGGVPIPALTLDQTLPCFVLLKRLGAGEGARRAQNAETGALSAALSYILKEAGDDIGYEDEYPVEPVVVTIGSYIAPKPLRQGEFKVLWDSLGSQGTEAVGKFCLNFRSLDSAVTGLLAMLNLAPCDRSESVDPQKTTQTVLCSGNFLGEASVLATAVVFMSPDHGCLLKLVVRSDDASVCDAILQAFE

SEQ ID NO: 256 - protein, 118 aa, Neospora caninum
MSKLVKGGLEGEEQRLHRIRITLTSKDLRSIERVCTELINGAKEKNLQVAGPVRLPVKTLRITTRKSPCGEGTNTWDRFELRIYKRLIDLHSPSDVVKQITSINIDPGVEVEVTIIDM

SEQ ID NO: 257 - protein, 158 aa, Neospora caninum
MAPKKSAKAAAGEEGEAAAQGTGLGPATRDGEIVFGVAHIYASFNDTFIHVTDLSGRETLVRVTGGMKVKADRDESSPYAAMMAAADVAARCKELGISAVHVKVRAAGGTRSKTPGPGAQSALRALARSGMRIGRIEDVTPIPTDSTRRKSGRRGRRL

SEQ ID NO: 258 - protein, 156 aa, Neospora caninum
MSIQVSNNQDFQHILRILNTNVDGREKVVIALTAIRGIGRRVSNLICKKADIDTNKRAGELTADEISKVVAIASTPQQFKIPTWFLNRQKDVRDGKHKHVVANGLDTVWREDLERLKKMRLHRGLRHYWGLKVRGQHTKTTGRHGRTVGVAKKKGC

SEQ ID NO: 259 - protein, 355 aa, Neospora caninum
MKLSSPLILTVLSFICSSDPTVAVSNEHGGPTASLSYARFARSGKRQPQLRARSGSFLEPIEPFLNSDDIGSNDRYDGPLSFAEADDRREGAAVRSPGDVSGSPVEDQQILTEEGKDGDSVYASASSGLNEDSGEKQSEPVTLENYGGEGEPVTKHQAETDDYGYPRHQLFVRPAIFARRRHENTLSDDIWPSNVSNHAPGIQHPLLKVGTGTGAYSQPDQEQLSDTQDRLEEQEPIGTEDQPPGEQEPIGTQDQPLGEQEPIIFKSQANQGSPLPPPRPNLLRRAAGTAKTRARALGRGLKGLWGKAKRGARRVGRGLMSGVGWVKRRFTRNPFRRGRREAVEDTEFSSRTQPQ

SEQ ID NO: 260 - protein, 277 aa, Neospora caninum
MAFTSAPLNRVPSRVLPYALSGVYVHPKTVCRLVASPRLSSVSSSSLFSAPLSGPTSLSSLSSSASHPVTAFPRHFSSAIPPANSAALADPLPATPTPPAVFESLSSSTASSSGAVSSAKDARKNVEEIATMERYEAAVYDESHKKPIICLFFARFSLQSKVLLQPFLDFAASASNNATFFLVDCDRVPRAAYHARVENVPSIVVMKGDDAFRQTITDAVGVKTAGELIQEARGALEQVVRLDQLEGGTKLQPGVSSYTHHIGVDNLNVYRKGWPVA

SEQ ID NO: 261 - protein, 395 aa, Neospora caninum
MELSFFNVDDGYLEGICRGLRSAFLTEEDYKKLSAADSLEDLRSALEETDYGPFMQDEPLPLAVPTLSQKCREKMASEFRYMRSQASGPLGKFLDFIATEKMIDNVVGLIQGALNRKSAHELLARVDPMGYFQEMAAIANMDLTTSYEELYRALLIDTPVGKYFQAFLAESSSQAAAHASDHGGRSLAEVASIVSETDIELMRNSLKKGWLEDFYAFTQSLGGTTKEVMTHILKTEADFRVLRLVVNSLSSNQQQQMDRHALYPSFGYLYPEGTDGLRKAWNDATVRTALAPFSNYLNLYEQCKAFYVGQEGQGNEAVDMASNSKFKSLEDLLYSETATMCELAFEQQFHYGIYYAWVKLKEQEIRNIVWIADMILMKRKEYISDQIVPLFPPRT

SEQ ID NO: 262 - protein, 336 aa, Neospora caninum
MPAASSPAHAVKKTDTFMKRAQPFAVGGLSGCIATTCVQPIDMIKVRIQLAGEAGGSTNPFAVFRNITKNEGITGLYKGLDAGLIRQLTYSTARLGLFRIISDEMRQTGPKDKNGVAPPLPLWKKAVAGLAAGGLGSFFGNPADLALIRLQADATLPPEQRRNYTGVLNAIGRIVKEEGLFGLWRGSTPTVLRAMALNMGMLASNDQAKELLEPSFGKGWTTTLGASAISGFFAVTFSLPFDFIKTRMQKMRRDPVTGELPYKNFCDAVIKITRREGIMSLYTGYPTYYVRIAPHAMITLISMEYLNKMWNSPHSVDRMNEAPKVYRRATTVNGGT

SEQ ID NO: 263 - protein, 434 aa, Neospora caninum
MTTLEQNPADELVDYEEDEQNDAKEKGVEDVVVGRGNYVSIHASGFRDFFLKPELLRAIGDAGFEHPSEVQHETIPHAITGVDVLCQAKSGMGKTAVFVLSILQQLNLDASGEEGNTQGVVCLGIAHTRELAFQIKNEFDRFSKYLKNVKCEVVYGGISIQKNIDMLKDPKTTPHILIGTPGRVLALIKGKHLNAEKVAHFVLDECDKCLEKLDMRKDVQNIFMATPKKKQVMFFSATMNKEIRDVCKRFMQSPVEVFIDDESKLTLHGLLQYYVKLQESEKNRKLNDLLDTLEFNQVIIFVKSVSRAQALDRLLTECNFPSIAIHAGLDQEERINRYQQFKNFEKRIMVATDLFGRGIDIERVNIVINYDMPDSSDSYLHRVGRAGRFGTKGLAITFVASQDDTNVLNDVQTRFEVHIAEMPQSIDASQYINQ

SEQ ID NO: 264 - protein, 476 aa, Neospora caninum
MAVPAAVSAATRRGLSSLLLPDCRPRLSGFVPANPAPAGAKTFSPCVLKSALSAISRQKCRSLASLSSKLATPEFAVPRHGAGPQWDGGSRFLSSAASAGKVVPVPSMGDSITEGSLNEWKKQPGDYVREGDLVAVIDTDKVSVDINAPESGRIVKFEANAGDTVEVGKPLYVIDPTAQPDPAEVAPPAPAPKTEEPKSSSAQPPAEKAKTPTPPKAPTAPAPSATSGKASKTAAAPAGVQSAGREEKRVPMSRMRQRIAERLKGAQNTAAMLTTFNECDMGNLMAMRSELNPAFQERHGVKMGFVSAFMLASAMAMKKVPEVNAFIEGTEIVYKSNVDISVAVATPTGLMVPVVRDCERKSWPELEKELAALAVKARNNQIALEDMAGGTFTISNGGVYGSMMGTPILNPPQSSILGMHGITKRAVVKNDQVVIRPMMYLALTYDHRLIDGREAVTFLCHIRDYIEDPRLMLLDL

SEQ ID NO: 265 - protein, 616 aa, Neospora caninum
MWETETIAELPASGAGAVRAPIDLREDLNLEGYWTDGKEAFILNIADEDASFILGSGGRTKRKLSHVCGADLNILERDGRTVLEIRGTPDTIDKAKLYIGFVMQQRVGPVALPPDAEKRDDLTIIHVPHECVGYVTGRKGAGLRSVEEEWNTLMFFTDLRSKEAGETEKLAIFGEMRARRGSELKVMSAVEQKMPGYFIKDDEEHFSNNPDFDTDRIPIKLEDYSYALGQRGSTRKKLARASGAILEYVGRHAYIAGTMAERTRARQYLQWLCAQRTSYVHVETDGRDDCDVVSLPVDAVAYVTGSKGSNLRRAEEETGTFIFLDGSRGGRDERLLIFGWNAEARSRARQKILARVDEKMSGRARPIGAGPGRYRSRSPRYDRRYGGYDDYRGGYGGGYGGGYGGREGGRGYYGGGGRGGYYGGRDRSASRDGGYGRSRSREYYGGRGRDRSRSYDNDSYRSGGRDRYRSPVRISTSCRLGFYVEAEFAQSHPVASAPSVFARVSYRFCQGLRAKSSERIRQTLSPVPRAIGTMLGHMNVLVDQGRVFGLLTRHRLAVRDHVRTAFPPPRRQCGDTWCKACFELPGQPALRRALGGALRAERVFHVPRPWRGHSVC

SEQ ID NO: 266 - protein, 759 aa, Neospora caninum
MVRIEKDDLPAEEQDLLEFLSEDSDEGEDDDPEQAEEKLKEKLSQMEPLLQMDYSFPSTIVLVGVPKVGKDKHEKLRLVLDKKMVEELSKKGAESVNEGLTISMPVNEETGMTKGFCFVTFSNQFNAQHAAHHLNGWALDAKHTFRAALLDDFDEIVGRGANYRPPIKLLGFTRENFRWWLLDARGREQFVIRYADETEIYWHDPIERDCSVLVYNGHRERADGKRVWTDFRVQWSPQGSFLATFHRPGIALWAGDQFEKKVRFEHKDVKQIDFSPNETYVITWDGSPAQLRNEKAVRIWKVMTGELLRQFPTPAHSPRGGEYPHFLFSHDDRYVARMGEKELCVYQMECDEEPEAADGEKGEDKGRKGQDRCAVRLLRDPRDGKLSSLKYPLEKFEWSPTENIISVWIKGSEDAPGRLLLVEIPSRRELSSKNVYNVKGASMHWQSKGDFLCLRTVAFKKTGKKGKKEFTQLEIFRMREKDIPVDNVQLNDVAVQLHWEEGYSKRFALVVHDEQTSNQALRFYRVCDASEDGKRDTTLIYSFDISGYMNYMQWSPFGSYFILASLGLDGTLLFCCLNDQDTVQVLHMDEHFMVNEVRWSACGRYLSTAVVLPMLPSSNTASFRLGSNTGYKIWTFQGKLQYKCQKDQFYQFLWRPHPPSLLKKEKIEEIKKKMKDYSKRYEAEDEKLRLEQRSAFIRQRKEEMDEFTRVLDGLNQWKVDHDMYDEWQLAYETFDAQFDWEDKEEVIEEELEVKEEIIT

SEQ ID NO: 267 - protein, 112 aa, Neospora caninum
MKKSGTKQPVRLYVRGIVLGYKRSKVNQYPSCSLLQLEGVNDRKDTQFYLGKRVAYVYKAKTEKQGSKYRVIWGRIRRPHGNGGIVRAKFRNNLPPSSIAGRVRVFLYPSNI

SEQ ID NO: 268 - protein, 153 aa, Neospora caninum
MADTNAGKQPADAAVPAGRRERGATSFVSWFLVSLVILQIGFLAALYFQNLQMAAMGGEKAVRIQLLEEKIVELQAARAAAAKEDLSCPPCELLHEKMEKALKVVHDDFEKTADKLANSVNNLQSKVNQYGSKFDNLMKKVQNNPLLKQFGGF

SEQ ID NO: 269 - protein, 385 aa, Neospora caninum
MSRALSFPRFSAPLRRNFLALLVSASVALGFFAGPVIAFRSPASHPSFGSAATSNRLSQNPLSPAAEPSGLPTHTFVRMTRCTYTAPALGRQALRQEGVLGGSALWAARRGFVGGNWKCNGTTAKTKELVDMLNSAPISFEQVDVVVAPPSLFISQVQDSLRNPGVQVAAQDSSAQQAYGAFTGELSPKMIKEKNIPWVVLGHSERRAGFGGQPGESNQVVAKKVRGALDEGLRVILCIGETLDERESGQTQRVLSEQLEAVRLAVPNEQDWKSIVIAYEPVWAIGTGRTATAALAQETHRDIRNWLARAVSPAVAEATRVIYGGSVKGSNAKELFAGEDVDGFLVGGASLTGDFVSIIDAAKREGETSAQTPRPLRLYSVHPET

SEQ ID NO: 270 - protein, 289 aa, Neospora caninum
MAASCLRFSRLSPFGRQVEGLLLLTQSRAAAGRSAAFASLPFLSTSPASREALTSAASFRFLSPIQGFASGKRNFSKETDAQHSPCLVTKPAPDFTADAVMPNGEIEKVTLSEVCRSGNGVVLLFYPLDFTFVCPSEILAFNAATEEFAKLGFKVLGVSVDSAYTHQAWMRTPLAEGGISQLNFPLVSDLDKSISRNYHSLWNNSVALRTLVILDKTGKIRHLTMNDLPLGRSVHEALRVCEMIQEVEKNGGKQVCPANWRRGEKMMEASFAGVKNYLGQLKAKVETKL

SEQ ID NO: 271 - protein, 559 aa, Neospora caninum
MNPSPASALNPFSTPSSIPTAFSSANSLPPSPRGARAPRVRSSRRLTPQTISSQSSERLSSAFVASGSPASLAHPASSPSSRPEQSASPSAPASPTPAPSTARLAAVHLPQAPQAGDLSDFSAAFSSGDATGASRFASDRVATSTAVAAGKGAGETGSFSPTERDCLSPQQQHRELVSPYVGQMLLEDMLTGRMVEDACARLYYMGKTAGFVHLYTGQEAVSSGVIKLLRPDDAVVSTYRDHVHATSKGVPVREVMAELFGKATGCSKGRGGSMHMFSKEHNMIGGFAFIGEQIPVALGYAFSAAYRRFAMGDKSDPKADQVAVCFLGDGTTNMGQLYEALNIAALSKLPIIFVVENNNWAIGMAAQRSTAIPAVWQRAESFGVAGVEVDGMDVLAVRGAARRAIDRARRGEGPTLIEALTYRFRGHSVADPDEMRAVKQKEAWVVRDPIKSFEEELKRLGYANDETIAATRTKVKALVDDAVKFAETSPDPDVQECGQFIFAPPYADAGKPEPLTKEQLHEYAVALKQELDAKARVKAGDKTPQPSVLQSDNPPIVID

SEQ ID NO: 272 - protein, 215 aa, Neospora caninum
MATCTVVVTDYTGGRQGADKDKLEVAINLDITVGELKQKLIDMRPGLDASRVLLYMGKIRMDDSKKVVVYNKSKRARIALELYDIFEIKVKVKTLQHCGSGACVMMPLWAFCCRQTYVLEVPDHETVGFLRRRVCEELGDNENYPLSKIKLGFDRRLLADDLEELRSIGIKDGSTVTLFVKLFYFNTQKAAGDAEEKNGASVPPAPEKQESAQDE

SEQ ID NO: 273 - protein, 490 aa, Neospora caninum
MLVLVETPAGYGLFRVKNKKLLEVEDASDLTAFFDSAEGAQQNVHLEAFSQFKDTKHALEEVLALRESKMGKGLKKFLKKNVLQTEASAQLAVSDKALGAAIKNKLGIDVVFTPTTHEIIRGIKDQLSNLLDGLSAKDRQQMAMSLAHSLNRFKLKFSPEKLDTMIIQAVALIDDLDRELNNFAMRLKEWYGWHFPELSKIVTDNLIYAKTVQLIGFRTNTKNIELSPLLPDEIAAEVKMSAETSMGTDITEEDLMHINTLANRVEELVEYRANLAEYLKVRMKAVAPNLTYMVGEVIGARLMAHSGSLLNLSKQPASTIQILGAEKALFRALKTKSHTPKYGLLFHAALVGQAPPKLKGKISRVLAAKLSLCVRVDALTEAAEAAATAAGKGEEMTSSAALSEPTVAISCRRYVENKLLQLEQQQNSGLSRSAAKPPLARYEPKRQMNGKSYDASTDVVEEKKHKLSDVKSEDEEEKPKKKKIKRERED

SEQ ID NO: 274 - protein, 1222 aa, Neospora caninum
MENSEKEEAPREASPGTPLVPATLNNSVRNAPAAAVDEPVRKESKPLVLEVRGFLEVVDVKGPPTLNVRSVSLAGVPRRQLTNPTSREATAVKSAAPQRIGSKAEVKKEEEGKETRPVIAKAKVTPKQPAAAAPDAKATEPLAKPKVLVKKQAPTPKPTGEKQEEKKEEGQKPEQDEKDAQKPEPVKKVVLVKKAAPTPKEEKKEDEKKADEKKADEKEEEKKPEAKAKVVLVKKSAPKPKEEKKEDEKKEEKADEQKPDEEEEEKKPEAKAKVVLVKKAAPKPKEEKKEEEKKEEKADEQKEDEKTVDEKKEEKKPEAKAKVVLVKKAAPKPKEEKKEEEKKDEKKAEEKKEEGKDVKKPEAKAKVVLAKKAVPKAKEEKKDDKGNAEAKTPAKVALQAKEKPATKEDDVTVERKGEAVKGAAGEDTAVAAGKGKEAGVSSPLDQATMLIDQQTKETAKNQENEARKAEALKKVVAKKAAAKPSPKVPGEAADSTKEAGKDGAKDASGAEASVVKKVMKKVAGKASVKKADAPQKSAEAGKEEKEPVKAVAAKKAPAKAKKAAAGKKSDSAGESEGKKKVSGAAKETSSSADEAAPKKAKKAAAKKAVKVDSKAAAKKKVVPNLMKRAGKDEKAKDAAPKAATEKQKTAKTAGSEAAPKASQKVAKKTEAKKTELKKAEAKTTSPDEETNPKTEEKAKEQPDSTATPQSENVGPKAKTAAAKNATPEEAKNSPAEPEQAKEAAKGDKESRPQEAVDEQAKTADAQADSGDKAGEGAIGAESPPEVEERIQAVKSFEEAPAPAATHAGALQQGFANANQLNITRGQSIAIMHDLTKGPVPHVAVLPDRHVSEPPVMEPSTEHTIKKEIATPAPRRQMNWCQCCVFERPSDYTYQTRPLPPSDILAQRLATPDVQRRLEQHSAFLKYPGNVWIPPARKSHKSSRAHRPRKSSKAAKFLRCLGVPCSLLCQPTRSSLEAENDFRPKRSTATKLPADAGASKTKQEAAAATGSAEVTESQSAANAQLADASSQQQWQGYYDENGQWVSTNQGGYYDENGQWISTNQGGYYDENGQWISTNQGGYYDENGQWISTNQGGYYDENGQWISTNQGGYYDENGQWISTNQGGYYDENGQWISTNQDGYYDGNGQWVSTNQGGSQNDAGYYDEKGNWVWTNLTQTSTNYNGPSADQDYSGQWGEDANAKSGVEGEQDQNTEWGQEQSAYV

SEQ ID NO: 275 - protein, 178 aa, Neospora caninum
MKLLFFFLVLAVSAAVAENAGVQKAFMDIEIDGESAGRIVLELRGDVVPKTVKNFIGLFDKYKGSTFHRVIADFMIQGGDFENHNGTGGHSIYGPRFEDENFTLKHDRGVISMANAGPNTNGSQFFITTVKTEWLDGRHVVFGKITNDSWPTVQAIEALGSSGGRPSKIAKITDIGLL

SEQ ID NO: 276 - protein, 143 aa, Neospora caninum
MGKPNGIRTARKLRSRRRVQKWADKTYKKAHLGTRWKANPFGGSSHAKGIVVEKLGIEAKQPNSAIRKCVRVQLIKNGKKITAFVPRDGSLNYIDENDEVLVAGFGRSGHAVGDIPGVRFKVVKVAGASLLALFKEKKEKPRT

SEQ ID NO: 277 - protein, 435 aa, Neospora caninum
MWILLCMGNMACTSSYRGSAALPRGKRCSSTFTTCCTTPNCLRMVLMAIALVFASQVPAWAASMVSLVDAVQNSRVGLNAEATEREMKEPSELQRDVSPVTPGGDSSSDADTSPGITSFNLQNLQVIVDELKEERTVTDGSTSGESKQESGNKEGAETLATKQKVKEFVNSEGVDMEAYVPGSQGAYLQKALKKFYHPQSLLEPSKLKAYFFFHIGIIENTGAWLSRRSKYYRKNIEPAVTNSLNLANTFAASLEIVLAEALTEIENLERLRLQTADRKAFEHVRENNRLGVSVSRLREITWKLDAVLGEVSGTIRAYKCPPQCVSLSCRWTCEMKKTLPAEVESLAALTTHLASIFETIQEFVEKDADVGLKRVLGRTSTFERREAEETFERHANALSSSVEEFQRLLKGTGENLLQIDARMQEFTSLLKNGRN

SEQ ID NO: 278 - protein, 380 aa, Neospora caninum
MAPADIDEVPVQERRNNVEEQSEGIRLQTQRSAPHSGRSRGSFVSRRTSALTSKLRRNRKAIVMGVVGVAAVLAALYVARRWWTQKPREPGDSPPPEEPGDSPPRAGKPKAPSQPPTERRDVPTGVRQVGARDLPAPPASHTALLACLENRQIEFFGPSNSPHGFTPLYDPEPQKRVAMVDAGTNALFIGGAGVNGEVARLLTEEARRHEVRLTPEQLSEHSKRVQEDLLRLAVQHPRTLIELDTGARSPVFARSYGFVSVVPGTGWDESQTGRNVGATFIHILKDEVTPYGDPKNNAMVYTVAPSGNAPDASYSQAFVCRVVLWNHSRQASLFELRARESTPCRIERKGGEVRIGRRVVLWRRGAWRFLLGPLRVCQYT

SEQ ID NO: 279 - protein, 460 aa, Neospora caninum
MEEKTTAAPPDSFRVVLASVTNLLYPVDIDLIHYLFSKYGEIEKIVTFSKSPTMYQALIQFQNAEQARHALMNLHSRNIYDGCNTLQIQPSRLNELVVKNNTQKSWDYTVQSGGPSGSAGAASDLPPPGQAPGAPHAAGVAASGVNNGRNVVPPGTAPPHHPGAGPHHGPPGPYGAGAGGAQHPPIGGAVAGIQPPPPAHAMGHHPGAPVHGVRLGGAAGPLGIPHPYHHGSNLLHLLDKLPRELREIESTNPTQTPVIIVYNLPANITVQMLFNLFSLYGSVLRVKILREKSDTALIQYSDPLYATIALNYIQGANVLGQSLQVGFSKNMEVKLPPPNSQKTEANAEEEKRTVAFSIKDQRYGGDDVEKYVKGSCRPTKTIFVANLDESATDEEIQKLFKEHGQVSKFTFKAPKNESAKTQMAMMEMGTEAEAVAAVMYLHNHELHGRSMKVAFSKTVL

SEQ ID NO: 280 - protein, 648 aa, Neospora caninum
MRQPFVHWGLLLLVGSFWGRENGVKAWHDEGHMLVVAVAREYLKPEIVEKIEFILSDWSSQYPTTSTLETAAVWLDHVACSMPGRYCRGFLGLDDIRVFKPWHYTSHVFNPQNLTLDPVYEAKPYPQTGSSWILKKTYESLRNCTGGSRAVANSSGSAARAGDAKDGGVSESRGQGETNSTPSALPTDIFPSSLSSSFFPFLRVSSERLASLLSWKRIPVDAQVSHVGAASSSVTDSSASSDWSSASSYEARTAERDGVRRDAGKKTGYSVPETSVVCSRLSLNLHLRLLLHIYGDVHQPLHATETYSKAFPKGDSGGNNISVVLPESGKDGKGAVEANAHPGIEVAGSLPPSHQESLHSHWDGAFGQYNTLFYEIDLDALKKEAQRLVRLYPVDDHARRTFTDFYGISYESSMLARSHVFSEFDWSSFSAASLPYHPSPEYVEKSKKLCGKQIALAGARLALLLETLSDSLPQPLVHQPRSAPPSALAIVGGDGAVQVLTGCSASGDSLCISLKTAGESPMLVLSGPGSGLESAAIALAYSRPLAALFLLTCCALLVLGILLFWTCRQLRFYKHAVSLTTAVTGVSGRSETESSSVLSSGGLNVFRYLAGGSSAVRGAAAAPQRPTVNSEVAMSARLLDNREEMQRG

SEQ ID NO: 281 - protein, 918 aa, Neospora caninum
MRAPPAASDSSHPPPSLPATHAPESTLPSSAPCSAPSSPSSSAVPFLAATTASSLSPRPSRSPSPLPVLELHNDSPSETECALFPSPLDILESLLNLCECGHSDFSTSPRSVTPADSAPRSDTLAGRSAPSPGARLASTPVELPEFPLRVPSRRWRGYRTTVWRHATLPRSLSSPVRNAPGGQDQQSAMHAPGLSEETAAYDAGALCCCAPPPQGSLSVARMALVPPTRSYYYARPAPVLSPSVAGYAAVSGGSRVYAAGSPAGGAAPESFHRVVNGEPEAMYLTSPSAVAYAPGSHEPRHLTVPTLPPAAGTGEDWGESRRRLPVGAPPMERDAFVTEALLRKEAELQANARRLVEGTAGFEEVRQLRGDLCEKEMEVEQLKAEVHLARKEKGDLNADLLMKDAVISALKAGDDSDLPDVRTVDAVKTLREKEEENRLLSRRLEAMREERRDMRELLLQKDKQLAAAMSVSDTEAKEASAVQLGVQAIAMVQDSVELREKMKRLDAELAALKEEKGRRELLLEETFRKLTDKRKEAAGLLEMVSQRDMKLARVETFLQQRNRDYDQLQEESRAALRAEAARVEKSEEEIKILQEQQGALKNIVASRDEKVTCLQNEVVRRDALIKQLEQRLKVLSQDLEQSAGHLQQLLRASAAKDAYLFELESQLRRNEVERQASYLAEVSRTRRLALETRLKEEECRAALNDKEEALASAQHELSRNSLTLQQLRHAFATVEATDACYRPVESRAASPSAARDKAKDRESGTTSLPVSTTEDALYRIPTATSVPQRPLQESLRLLEADAVVHPRPAGTAGLNGLLRQPRKGDTSTVYTYYEASPQEKASVASTLALPAGFAPTPHTFPATQAYAGILRANTVPSGDVGVSRQGGRGSPTAYATLPASRVVKQVASKKAEESAQKQ

SEQ ID NO: 282 - protein, 1823 aa, Neospora caninum
MDGKGKDSSGPALLDGRNMDDLVGLEDNKEESIRVCTRMRPLFPKEVEARHVKAWKVDRNTLDLVVEPPSQLEMEESRYAAAGKSVAGTMKKAVEKTQGQKDIIQRHFVFDRCFDDNTHNAEVFDYVAKDIVLDCFKGINGCVFAYGQTGSGKTHSIMGVADDPGILPRSLAEFFDCVTDPSLLKEEEREMKRQQGEEGESNGKEDRDEAESENENTEYLMRVSYVEIYLERVNDLLQESPKGGAVENLEVKEDPKRGFVVVGLHEETVATMEEAMSLIAKAEQRRHFARTNFNETSSRSHVVFSITLESTRTFEDGSNVSRRGELKIVDLAGNEKAGRASEGVENAKLVMEEGKAINKSLFLLSEVISKLSKQAQLQAEGKQKKGDKEVYIPWRDSKLTRLLQKALGGNSRASVLVAVHPSNMYLDTSFSTLRFALKCKSIKKKVSANFFSPEQSLIAQQKKLILRLQSQLKALAGAGLFDHLPQRAAQSPENNEEVQQLKFPDAGPLASFWMFLFQVDLEKKINKFQQFIMKATKPSQGISGFEGFRRLDTLAAAKQNLRTIDKLNSGDIYSGDGAGVSLTKAFGFLARKQASRLSRGGTDSESYGSLSLGHLDTIEPAIDATVQELEDIDDRYEEAASSSGEEGEEGGLSESEARMKNVDWDVDAEEAPDRSPARVRLALSDEESCEEKARKDDSAPSSRGVSPSPERTEKAASSAEAAKNEVHHATGKKGEGKVKATVRIVDDVVQVEDVDQASSPSRVSFAGEKKKAAGEGMKKSALKKRSESPEGIEEAGAELARGVSVAKPSPKSALKNPKKKVSKKKIGKSKPSTEVSEKVDKADGEASAASEGLVDEGEEDFDDSEEKEQLKEDKMKMEGKVVRLRSEKKVLLEKLKKAKALGLEAVSRLTFRFKTEHESVKKLQQRVQDLNLQARYSSAILNKLGLSVLFTASVPAVENRPNMKLQSSSASLPEIDDDEQLTDAQKKLFERTTRFADFIKAFQEQGMLPADKMAAAGRGFSGELAADYFDFSSSSDAFKGLMFPDIDQVKPLAYAMINDVLARLMVMQAQASRGLVDDDTAVAEHSRLLENTLSIMRGEGIPTARSTPSEHAEDKQTLEQVEEVLGLVPSAKVPREDGAPVLESKISEADEVELQTNEEKRQRIAESVLSLLTPWEQNMLAMLYEQQEMRRALGELRDHFFNKLREMQLRFKRAMLERVEFSDHCERLLGALMDFKAELQRRQEKKTVEEDTNAKFGKLMSKIEEISIQLSERNVDYRLLTSEYKELMKRNDSLRNLVDKLKVEKATLLLAPQSLPHFEEINSSTADSTLRSLGYDVCILQRYGSRLLVEVEEARAAEAELRKLNAKLYTELAAANDCVNDLKTHINLANTVHTRTVSGLKTQLVDLQDELTEKNAHIDELQDELAALRERVAALESAQRGPAEEAAQLQSQLSSGSTITKGSNSMQGKEAVTSDKEEARSASDSDAHGRDEKKKKAKKGDGAKAKSKTKAAGGKKTRKPAAPTSLQVAAVGRAAPVLVCGAPSFASRQGFAFFPRFPREWQRLLPVAAKSVTPFSRSISLALGPWPLGFFSFRPIQPSACLRRVRAPCTIPFTCPATVRAAERGPRASATLPPVHLLAFRFFHALCGFPASFCLPGTASASPSRSATAARSASSRQASPAARGRVGNPAPAAPTPATAKTAKARPAGTRAVPGTLTAKKAASPASPSHVDRDSGARAEPAKPKAAEKPAVAAPVSAPSSPANVKAPPSPAAPAPAPQTQAAEPVPPAPVVTVAKAPAFTGDPRDKGFGNMAAALVRRRPAAS

SEQ ID NO: 283 - protein, 228 aa, Neospora caninum
MSSHEEYPPELTRGAKDSLNIPVGGEGLYARGTGAGSPMLFVMQWDRPTWQPVWEDEHQVIPRDGFGVPAQIPPEVSQHFKHVYYVPPQFFPFLKKLADDTPSLQPFMYKLIKGDFTYDDYEEMFYKFAKPLKIYRNQIPMPYRTPEEVAREEEVAWEGAWLSYRQKVLSSYNTAMFFREYLFGALIGVYCAFLFLDQHRQYRVDMKLFYLEAPENKVNWVVPRGDLV

SEQ ID NO: 284 - protein, 387 aa, Neospora caninum
MTDLKNLSSEKKLDMSLDELIAQTNATKGPQRRNAGNSQQQGRRTFHGSSQRQGPYSRAFGSNYRDAVGRDYLLEGSGAQGGYKAGGAAGSGPRPGVTPFVPHVYTVKVKNLPLDVPERELENLLRRHFGNCGNVVRIIFRQKNPGEAYIGFNESSSCSKALAELQGSKLKGRVLTIEKGQPTGPAPPRGQADFVRRGPVGARLGAGVAPAGGVVPLQAGPYGGNYVATTVHPNYVRGGPPSGLLGHCPPTLAYVPARAGADVGPPFSNGGAGAEWYADSRSGVAPGASPVAYGGSHGASLVGKQAPAQSGTTIIISNVPCDLTAQELQDAFSVVGAVLRTELLLNASGAPTGRVALTFESRHAALEAVRRFDGGDLNAHTIRVFLE

SEQ ID NO: 285 - protein, 457 aa, Neospora caninum
MGACKSKPKAKRPAEADGDNVGAAAPTAAPVEADTEMQNQGAATSPEGDAPPSQAEGNADAQPELEGDGQQGQAEPAEGADGSGEAGKAETPGDEPEGDRAANPAAGGYDMSAEPEVDVRTVEGDGVVGELVSRPVVTLANGVTYVGQWLGTKKHGQGVQQWPDGAKYVGQWKNGFADGQGIFTHADGDYYEGQWRMDKANGYGEYRHSDGSEYRGGWRDDKKHGEAVEKWADGSHFEGQYANGKKEGEGSFTWPEGSLYRGQFRENEIHGQGRYIWADGRCYDGQWAHNRMNGEGVFTWSDGRKYIGGYVNDKKEGQGTFLWTDGRSFRGGWLNGKQHGIGEFTARSGEKKRGEWDHGVRKRWLEDNEDVNEQGQVVKAETGATAPESAPGRTDTSGRPAGSSASLSLHPSGSDALNAGAQGSQASGSGRNFQGGNSGSLENPQFLTVNESAPVTA

SEQ ID NO: 286 - protein, 710 aa, Neospora caninum
MKHKKAAPVAVAPASDSDDSDSSEEEQQMKVQKGKKKAAGGSAVAKASQKKPVQPKAASSSSDDDSSDEEITKPVAKKGVTSGAAAVKGAKQAIAAASSKKAVKSKQMSDDSSSGESTEDETPQSKPAAKGKAQPAKAVARKQKEESSSDDSSDEDEAPNGKRQAAPKAAAGKAAVRKAASSSDDSSEDEAPAPKGKKPAVAQPSKTAIANKTASDSSSEEDSSDEDTGKKASPATAKKAVARTASSEDDSSSDEETPAPRDRPQKPAAGKAAQKKDSSDSSEEESESDDEAAPSKGKLGAGNAKQIAKKPTKKEESSSEEESSDDEPAPVQKKATAAQPKGKPAPKAPAASSDDDSDEDESDEEEEAPKKTKGEKDVKMKEASDEESDEDDEDEDEDEEESERPKKRKEAPADEESTHASKKRKEENAQPKARLQTKGGGVVDKLRTEIFCGGLPYSTTESELKELFESDCGPTTRIKMLEGKGIAFITFETEEAAQKAVEYNNTQYNGRTLRINLTADKQNHQPGGGERGRGRGGREQGGGRGGGGAGGDRPKAAPNKQVVVRNLSFNATEESIRSLFEECGEIQEVRMPVFEDTGKFKGQAFIEFDSIESATKAVEYNNTDVDGRTVWIDFALPRGSAGGGRGGGRGGGRGGGRGGFGGGRGGGRGGGRGGGRGGGRGGASSAVKAAKDGTVQEFQGTSKTFDSDSD

SEQ ID NO: 287 - protein, 488 aa, Neospora caninum
MNTALQVMRKVFFVLQGLGDRTVEGSSRYRARWRITCLCEGLQLRHLRALIASSPQALQSHASAAVSTCLSRACASAGACSALLEAQRGFAVGVFQRTKPHLNIGTIGHVDHGKTTLTAAITKVLADLGQADFKSYAEIDKSPEEQKRGITINATHVEYETGKRHYGHVDCPGHADYVKNMITGAAQMDGAILVVSAYDGPMPQTREHILLSKQVGVPRLVVYLNKMDMVEDQELVELVEMEVRELLSFYDFPGDDTPFVKGSALKALNGDTGEYGIQTIKDLMQACDDFIPEPERKADLPLVIPVESVLSIPGKGTVATGRVEQGTAKMNEAVEIVGGREKPLKAQIAALEMFRKTLDDAQAGDQVGCLLKGIKRDEVKRGMVLGAPGYLKTFKKFEADLYVLKEEEGGRKKPFFSHYRPQAFIRTGDMACTITLPETTEMAMPGDRVTCTVELLHPIALHEGLRFALREGGRTVASGIVTKPVQEK

SEQ ID NO: 288 - protein, 781 aa, Neospora caninum
MASGRRAEKGTVAALATAEKIGDPNFQVTENPGFLQRRLQVFDALYEKQNQRLKEKPRQEISIELPDGSKKSGTAYETSPYDIALEISKSLADASLVAKVLYEPGVGTEAITAADDEEEECACGEHEESQDDKWILFDMRRPLEGSCKLQLLKFDSDEAKHVFWHSSAHILGQAIEATFGAQLTVGPALTNGFYYDAYMGNATVTEESYGRLEAAAANVIKADQPFCRLVCSKAEALELFADNPFKVQLISSKIPEGGSTTVYRCGALVDLCRGPHVPSTGKVKAFQVTKHSATYWLGRQNLDSLQRVYGVSFPDKKLLKEYLKLVEEAKKRDHRMLGQNLHLFFFDTNVSPGSCFWLPDGAKVYNKLCAFMREEYRFRGFQEVISPNIFSCDLWKMSGHYQNYKENMYLFDVEGKEWGLKPMNCPGHCIMFKHLAPSYRQLPLRLADFGVLHRNELSGSLTGLTRVRRFQQDDAHIFCRMDQVKQEVADALNFLFFVYDQFGFSFELFLSTRPKKALGDRSLWDAAEGALKEALEETGRPWQLNPGDGAFYGPKIDIRLWDALKRPHQCGTIQLDFQLPIRFNLQYRTQDEAVAASREKAKDEKSEKRTENGDEPEATKEEEFGVEQPLRPGMARPVIIHRAILGSIERMCAVVIEHTGGKLPFWLSPRQCIVLPISDKVNDYATSVRDVLHSCGYEVGLDVSNNTVNKKIREAQLQQWNYLLVVGEKERADKTVTVRDRADPEHQHVLSMEDLLQLFEKQGMPNSKKTLTLDAWKTSQQ

SEQ ID NO: 289 - protein, 3982 aa, Neospora caninum
MPASPAARRGALQRAGADSVPLSFSSVSSSQPKSAGPPRLFEYFSSARFFRVSARGASRSKLLSPLLLLLILLAAPLLWTSLPAPQTRPPLFVFPGVSQASAAPRGQPELKIGPAQVLLPSPAPAPDPRVPSPALSVRTLLIVEQNGASLSSPPCFYWTAQHPDLIRLLHPDCSPSQPSSACFLPSASLSAAGDGAPACLPRVLVEASPHTHRRGRSWIFATPAAQPNAGRQVSPTSMRVQAVVAPITRLAFRTRDRRLAVGQLGDVGVLAFDEEGNIFTSLQGLVFLWRFEGERGILQAEDISSDAEAATPTRRWVERTSEKAAGGVHAPESAAARVGSTGSAGAFWRSDMLLVRGLKTGKATIIVRLAGEHYQHVGEARVSFVVHEPVMLLPSFQVLPPAAVYQYRLLRLRERTENASGSPEDSFALSPHSRGPSYVSLPSPHCKFSAVDLAVYDAQDRLPLARAADAASSSLVSIDPSGLLRVESPPEFPGEGVQATRFGLEGASLLRAVDTRTGEEQHAEVLVLVPSALRLFVDDVQALEPQAVWRQLLLAVRKQVRNLGGGQQGDEAQSRDLLLSKLVERAWGRGDLRFDKKLDEGDALGAPPAELVMSLVKTSSRRGSEDEEEEGEAVLYLVRGTEYLCKVEMLARRLPQGLGGRGEASGTAGEEELTEPQHAPPGADTSFENRSTQDQDDAQFLVVSTPKNAAFHWICESEEDEDSETGESERDRETAFERDNCGLQRKGSGQQFLAWFSATRRSQGRLTASLLHVGSRSGGAKAFWQPPVPLSLSLRFRVVDPVFLLFFPHPREETGDAVRLSTEQPLLLPPLHSFEVEPWGGSGSYTLTSDSPLISVQRLPPSPAAPPFSSSGLLGPLSWGDNPRAPRASSDSPRVRFRLENRARNSGDGKAAGKARGGAHATGAAVLRLQDARQPQNVFEFLVVVAEPERVEVSVDTFLIRQSGKATNEHGRDSRRGALREDRRNGDASGQIRDDVTHAIAVVTAYARIPPMLALPPKVAEWLSRSSLSSSRAPSLDSAAHAVRQAASDWSTELDRADERAWLSRHPFHLHPLQFANCTNLLPAAGEKREDRRFWTNSPEILMISELRPALPYTCGVFRLTGKAPGSARFFFSPSASLTAGVTVDVFPPLEAWVVLDRLFLPLPFSSRAPPHRALHASSSASAGVSSASEGDTAGPKGSRFEPQRLSPPSACQECASPLLYSAPVSSVASYHPAVAYSQENGETPREEILTLAVGSSLTFFTKGGPPARPALYTQHYTGELESDASPNASLLAIANENRDVLRVVCVHPGTVPARVIMEMTNRPREGVDVDAVSTSVRLAIVCSIPHRLEIFTLPSFSTPTAAVASPKPVTLASFPVSPSAAAAPQVSPVSPVSPLSAPTLFLRCGATHRFLAVAYDAHGQPVVNATSFSVSTDSWNLTRDGRFPPAETGEASGESGAGRVSLVSFFEDFEAIGSRGTARSEAVAVQVAPSSCCGVFALSAHLTWPTADSVVTEPALRGEDRAVLVKALREAREALRGEAQTAKASAWRADRLAASLSLVVLPPPRFLAPHASFLPGFFPPQRERTPAPIRLFYHPGLVYRVLLQFASPHSQLKVLPVGSELSPPFAVYTETPGSALLTEHTQAAFFSGLSPEATLRRFASLFHASTEPQGGPIAPSGKQRGSAHFLTPQDGLDVTTLVLAASRAQRDAAVSPLFRLPPPFAWPGNGRVCSPACPVTEQEVFIRPPSAAGGLTREADARDTRGPVVSGRLVVDDTGVLGDTQAQEEGTKGQAPPAVDLQFFSVARLTLAVLPPETLLTRSARGSPGREEQRKDWIQGDWGEIEKGKTYGVKVAAFAADGERLDPAFYRAMELALKISRKSKRDSGAEEAVPAASGRPEDDDASEGAAGRATGWLYVQRAEFDEQEEARPNFPPQSVSEAEISAVASFSPAAGGFGAFPALRGEAASELLWKTEVRRLFAESPCGGGDAAQPSRDDCPDFFFYVDGFEPDTELLLSVEAVNWAAPPASRSAASALAAQAGRLAVSAEMSLALYPPLRVFPASLVLLPGGHSLQLTVRGGPRRRRGDARKLDGVPQSSAVRRCESSDAAVVAARVGQRDSGPVAREEGDETASGDSWDAFPVVELLTGEEGQAVLTVHAGDQTADGSPPAASAPSQSRFLQLRRAAATVEVVVALPARVVIAQRSPVPGGNGFVSAHQERLVQNLQRLRFGAELATSSANANTHEEPFAHRADAPVQLGVDLTQKLHAFLYDAEGREFNFGHLAAPTGDVAGVGVDRETLEGRRRLEQFGPFAALPPAAASLCTYTWRVVDGETSAVGLLDPNAVELAATCEAKPLRPCAFSALPLPAAAAALRRSVSGGMPSITVVGLREGTARLRLGVECAPRRREPGRPVKKVVLETEVSIVVSAVPLFSTLATSSALLESPSLSSDVALGRAALSAFRAWKPAGPAWWYGLFASSSALPSTLLAAPASEYRMPCCRVRLLPDASSQEASCPCASEGVRREQKQTEANPSPATCACAASPNAKPLEVLPGEGGFLTSPAVASTRLQIEVRPSRGASFAASQSGSEASAGKEIDARRRDASWQVTRVDVVAVASVELRVPTRTMERAVRQRGEIVLKDAKGRVILPPTDLRIDVFSSHTSVVAAEVETRDARHPFGPPTVVLQASSAQSGCAAVTVFLLSPAFLSDTVRVCTDSRAFPSPVALALRPALSALPALHAASALPVLPGSVVHVLPDTKVSVHRVQPHVSFRLTFRLQPLLASLLALAVDGAGTAESPQAPLVHLFPAFVWRGAREVAASAPDCLSLHAVARIVDLFAPALAQSLHISLASLFAELRSQVASGPEAGSVFSPAFAIDEPLVHFAEEPVIPFQRFAFCGKRPASAARQSCAAGVGRCASDSPAPPFASTSAALLPSSLSLRVSLHDVPAVLASLVFNESEREGKDGGAVNDVLLRVDGVDAFFTLLRRQLASSWWREQKAYRQRKGATEERSCALPGRQTRDRTGRRSAFSSGGDARVGASVSRGRDGEETGKHASTLPTDECTDTPFGGSRDVPSSVSRFFSLLGFLDWSASFSPSSSCLSPLCASPFFAAPAAHALWSSSRPAVASVHTPRSFPPRGASPFAASETAGNDAYDVESPTAIALSPGLASVRTNKSAVLNLDVVPVRGSERETADEVPASAKRLRLVAAAGCAAQFAENAETQEAPLLSVASAAWGVLSEGEVLPVSRLERLGCARRRDGEGGGESLVSLSRRAPSREDSTRGGRTETRALPPEGEILFFRLQASLSPTAAAPQRGSGGERGERTEISSGAAWSDVASSVYVQSSGGVQCAVGDPRLAPLFVVETAQLPLLSLDGESETTGRPVRTQASEAGKGGLTHPWMSRGDGGDALQLAHACAFQERRLLSVKSDLPHLLRLAQADAASSSAPSRETAQAEETAASFPCGSASLSFASSARNAATSAASLHTFFLPISVSVRTTLASRLLAFPPGRLVALTTSDERGDAAQTSLRQRMRYLFEKSRQPFPDSRGEAVHSPFVPSACLALSFQPKMHVLFDARAMHVATPHVLYVKETQWRRGGDAEGRSEGPTSEDLFEAATAGGTGEARSLGETERPEEPERSRGSAALRVADAGAKLPLTVFVYPVPPLPSEEAASNRVSVDVSVSSEAYTVRAQQRGLLLAIRVDAAPAEAPSETSRGQKRVQKEAAPQWSVWTAPESAQLTIESREWKQIVTLSLERTTARLHTTEEEKGEETRLLFPSTFFSSSVSKRSVRSEGESLGETGSRQRNEQARTERKQKEDDGQDPTRSIGEWLIVLTLVGVGLLFLLHQFCDFFRRRPSPAGPLTPRKDATAAASLAFASTSFASSRFAPGKSAPSRTATEGPTLLREKAKLQAARQADAEALSSALAASRGGRDEGLGGSVRTPQQKLQMQPDGQWKWVGESGGEESVPESLWRNAGDFYGRMRKSCK

SEQ ID NO: 290 - protein, 624 aa, Neospora caninum
MADAVDVPQIKNLYAEAWKQQYSDLRLSTKQTESCGLAANLEYIAAPWDVGGGGVLGILRIADIGRNPAVGKIKGHTSSIQDTNFSPFHRDILATACEDTIVRVWQLPEEVTAATELKEPIATFTGALKKVLSAEWNPVVSGVLACGSFDGTVAFWLVSESRLSSRPLGLSRTRGNVEKAENFASVKFQESLLSSKWSWKGDLVACTTKDKVLSVVDPRTAKVVSSVTCHEGSKACKCTWVDGLAGREGHVYTTGFGKMQEREMAIWDTRKIDKPVYQAEIDRGSSPLYPVFDETTGMLYVCGKGDSSCRYYQFHGGVLRPVDTYRSNIPIKNFCFIPKLAVDQMRAEIGRMLKQENNNVLQPISFIVPRKNQDVFQADLYPPAPDVEPSMTAEEWFNGQNKAIRRRSMKPGDVVSSQPRRMTVDTASVSAQAANALPAADAQALQRLQSEVASLKTQLLEMDRLRKENEELKANAAEITALRKENEELKAKAKELAAQPATAVESTAAEDPALKKRVSELEEALSSEKDTSAQLEMRLRDLEGRFVSATKAQKAAEQTAEKLDSRVKELEAKNSELKTQMEQAHGTLHRAATLTGLDSDMKNELNEMRDFFRDILQQAQNEAA

SEQ ID NO: 291 - protein, 558 aa, Neospora caninum
MRLRRSGTFFPQGRRLSEASQPQIDRVEDGLSSGKEDGLRHRSDEQLMADVARVRSFIGCCVKGWEKLPADAIDVTVLSGGLSNRLFAVEAVPPVPSGNGNDPDADERQPRQHRHCPCDSRKEQSSTAPDSRSPYPAWDATTPPQRVLVRLYGHGQEHSFFDASEERRVFKILGELGIAPKCLAEFPGGRVETWITGEALKRTDLQNEAVQSRIATILGNFHQIGLPRSSESASAADPAWCRWVQQLPKVFSERIDSEECQAEHARPRCDFAFCRLDAWGATAREGPAMRLLTRSQIPALKVALSREASPDAHEAGVVTPVVAGPLSLLSDAEKRRLDEVGLVQYYQEEAKKLEQVVLARVAHELEPQRLKAVYGSADAWQLLSGASVVFSHNDVQENNVIQYEDGRLQLIDFEYSGRNFRSYDMGNLFREMTIDYADVEGYPFFVVDMSDYPSLPTRQRFIRAYLENLLSVYGPVSGASKAVPHGTVSKTVVDNFEVMVELTGLVSDLLWAFWSLTQMPEVEPLDEFSHVQYALARLTMYEHKKNELVRRGLFPARG

SEQ ID NO: 292 - protein, 925 aa, Neospora caninum
MANAADENVFANDSSYHWEMRRKASFSKLTGAVPRAFPGMYNEEDPHADVKKEKLWKLMETYISSDIHSIQRSVVNHVEYTCARTRFNCDPESCYRAAAFSVRDRLIETLNDTNAYFHEKDCKRAYYLSLEFLLGRAFQNALVNLDIENNYKKALAELGFNLEQLYEYEHDPALGNGGLGRLAACFLDSMATVNLPCWGYGIRYTYGIFEQKIVNGRQVEHPDYWLTMSNPWEIERPDCTYAVRFYGSVKEYRDAQTGKMRSKWVDGEIVQAMAFDNPIPGFDTYNTINLRLWKAAPSKEFDFHLFNVGRYLESVRERQRAESISAVLYPNDNTMEGKELRLKQQYFFVCATVQDVLRRFKKVSNRDWNDLPSKVQMQLNDTHPTIAIPELMRILLDVEGLEWEQAWDLTKEIFNYTNHTVLPEALEKWSAELIGKLLPRHLLIINEINFRFLNEVRGVFGDDWNKISRMSIYEEGEEKRIRMANLAVVGSRHVNGVAAIHSELVKKDLFPEFVEFYSRQGFNNKFLNVTNGVTPRRWIYCANRGLADLFSNWLGSDSWLKELDMVAGLQNHIDDPQLRKEWRAVKRQNKMRLAAWVEQRCNVKLDVDNMLFDIQVKRIHEYKRQLLNCLYALHRYLTIKKMSPQEKANVVPRATMIGGKAAPGYFTAKNIIKLINNIAQVVNNDPDVNQYLKVVFLPNYNVSHAQVIIPASDLSQHISTAGTEASGTSNMKFVMNGGLILGTLDGANIEIREECGDDTMFIFGAKEHEVAQIREQAKNGNYPIDGRLREVFDFMRSGKLACGDGQAQSDFVAIVDQLCNNGYGHNGDFYLLIHDFRDYCRAQQVVDETYKDVEQWTTLSIKAASSMGKFSTDRCMREYATEVWNIEPCERPPPDEFQRMRSFANDTPNKVSGTASSSKSHKSRR

SEQ ID NO: 293 - protein, 551 aa, Neospora caninum
MAAALRFLNSALTPSRSVFASGRRTQVGPLFFTENARLRGACSRRFSSAAGGPTAAAADARKPAAPASQRSDASVGAAVGTPASPSRETGYSFSTGRHAADVYDVFVVGGGVTGTALLYELCKFTDLKKIGLVERRPSFAVVASCPRNNSQTIHCGDIETNYTVEKAKIVKRQADMLRNYATKLPPAERDMVVQKMQKMALAVGDAECEFMEKRFHVFKNLFTRMQFIDKKKIADVEPRVGMKNSHSLRPDPTCAIFIPDEHSAVNYYHLAASFVDQAKKHANGKQVDIQTSTELLDLQHDGDTFSIKTSRGTERARFVVVSACGQSLLLAQRMGYGLNFSCLPMAGSFYFAPEMLNGKVYTCQDPRLPFAAVHGDPDLVAVGKTRFGPTALPLPMLERYNASSISDFLRVINPDMNLVKVYLDLLGTSHMRNYVMRNFLFEVPKLNTTLFANDVRKIVPSIMPEDLTYAKGYGGVRPQLIDKEQKKLLLGEGKINPGTGIIFNITPSPGGTTCLGNAEMDMRAICKRLGANIDEKLFRQTLLEGEYSVTH

SEQ ID NO: 294 - protein, 207 aa, Neospora caninum
MPGKQVRRTAFSAVLLVAAAALGASRDPTGDVPEVNVTWEALPRAGCVHATVPSQSEAPGEQQSSPLVKEEEKNEQREDEDGEEEEQGSLDVLEELAVLRREIDARTNPPGLKRGLAGLIAAVAVLAARNRFPRLFPRTASLFVALPAALFSAVFLSKYFSHGRRMRNPPKTFMDEIKARVPFSGYGQEKSNKKKKGKKASRKHERN

SEQ ID NO: 295 - protein, 463 aa, Neospora caninum
MTTFVPLATDGDGTASAVAVGDWLLQIINLKNPAQTQSYYTQFLEQFDKDEETGEQRIRDHFQLFELLLSQHQLVFNYATHARQQPAGEKSDRPAATRKTFLEAVHEVEEFFTVLIAMVVLRIENVEQAGQAAGTLCSVFRASTDMAEFRLRLLQSLYNAFPPNFPYRFPIFVATLEYAAETNLFNVMLPYIRYINEWMRDWNLPPSSKRQVFLILANELKKLKKADEAYPFLKRHVQFFQNEKEEILANGATISAAVELVEDSIRLPDVIVFDGLMDLHAVVYLRKTAHAPLIELLQIFVNQGPKELEAFKSKHPQVFEEHGLNYEQCLAKIRLLAVASLVHGRKKEVSIRAIGDALQLSEAGAEEVAVQAIGQGIVDAKIDQMARVLHVRSAMQREFGRQQWEELLERIEHWGEGVRALIGCMQSVKNQVASAAAGSSPGGLSPPGASLGAAAGSVAAPQQ

SEQ ID NO: 296 - protein, 880 aa, Neospora caninum
MWGMTECRGLSPSRRQRLLRLAGFNGLLLLCLSILAACEPETKNDRPSKLPETTYPEFRFGPAIRPRKRIPSRQSAAAWMRLFGDMTLTELALPATVHSTLTDVTAPRYMDLTHAQNVDINRQLYDGIRSFDVRPWRNSRDGRWYSEAPWRLEEDLVTLRKAVSSFSQLSSSPIAALPHSLQNTIDLHSRTTLEDSLFRPVQRFLRSNGSEVAVVVFSALNGNRRGGVNSVEQASSLGAMLKRYADYNQPGAKADPSSPLPPFSDLSSPTFVEGHPGGDTNRKGKGKPPTFEVVSPSDPSASFMTSAVRKPLTYEDVQALLELIDEYWGQLLPRHDHVFFGPPVKKEAREPAGSTAFPGAAGRPQEAALKRADADASGPAYPMAESVNRPEVFAKWLRQQGEMYLSELPVREIVGARVQLLLFVDDPLVAWYITTFSHEHVMVFVAGDHIYDVSYRSEALFAPCGIPHRTGPIGDELTLTKERSWTECRSKCESLSSTHLPTGSRGACTYWTFGPVPSSYENSNAGDNSAPTAPVYDCRTFAGSFTVQNLAPRIGAVTQAVDCGPSSLMEDPMQWSASSLFSDLTEAVCPIAGAGVSAVSLNVLQPFARELCLLDTSGASSSASRRRRGSKSGAPVARGVQALKKLIRVHFAPSSPLFFVDGTRGGKRHFGTVDVTAPMNRLTVPWVYWHLERQQLLEGLLTGTGESRELPAGISRARGSRGGQLTRPVNALMVMRYDSLNNEIRNGQPFNYFEMVMHLNPLPAAAAALALEGDVGDFSAEHYLHLTAFHELPGDSEAGALFSAFDLSKSSNAPCKSMIWLVVCVSILCLVAMIVAFVCGSSIIWKKPPPSAHGDWAAAPIAAAQAGAPTVVQMGTIDAA

SEQ ID NO: 297 - protein, 434 aa, Neospora caninum
MAFDGPNNGAVGSMPEDDSGIPLPYVEGEAQPQQNSEMLQMLQQGQPNAGLEQDGPAAGEGANAGDVAPAFGENADSREGPRNEEDSSPPPASDAEDPSGGSGGDGQNSPPRESDKEVQMRKLFVGGLSRSTTTDSLRTYFQQYGDVADSEVLFDKFTGRSRGFGFITFTTPEPVSRVADMRHTVDGTQVEVRRAIPREEAREHGGSGADRDAGRLFVGGISDDVNDESLRAYFRHYGEIQSANVMVDRQNNRPRGFGFVIFRNPDDAEKAIGPHKKLGVHCEAKRAQPRQMNRDRNSGGWGGSGSNWGPGGYGGRGYGGGREGGYGGGRGRDYGNYGPPGGAADPAAGYGMGGPGGVYGGGGYGGYANYNPYYAAYYAQMAAYSAMGGYGGYGGAAGAPGAYGVGSDEGGYGGSPASGGADRGNRMANRSTPY

SEQ ID NO: 298 - protein, 495 aa, Neospora caninum
MALAASGVGRQLLAAARLSCSSSSACTLLSSQPSLSPSPVLCAVSPARQPGAGGQSKSLSFQRDQRRFLNLHEYQSMKIMKEFHITTPKFAVASTAKEAEQEAATFLSETQSGDGEPVDFVVKAQVLAGGRGLGFFRENGYQGGVQVCESPREVGIVADKMLGKTLVTKQTGKEGKTCNKVLVTERFFIRKEKYVAILMDRSAGGPILIGSARGGTSIEDIAHNYPESIHKMPIDINQGISEPRLREFAELLGFSGDRLEAACQCIRGLYELFTSKDCTQIEVNPLVETHDGRVLVCDAKLNFDDNAAFRQKDVFAQRDYSQEDPREVAADAADLNYIGLDGSIGCMVNGAGLAMATMDIIHLHGGSPANFLDVGGGADQLQIIEALKIIQQDKRANCVLVNIFGGIMRCDVIAKGLVAAAREVGFDKPVVLRLEGTNKEAAKEVLREVRTDPAYASLQLLQEDDFDKAAQLAVKVASVVDAAAKANLKVHISAP

SEQ ID NO: 299 - protein, 915 aa, Neospora caninum
MANSVRPAGALAGSPKAEFAAARVSSPRVRRLPVFVLSALLAAAAVAVWTPSTDSSASFPVFSAVQPAEAAGFMASMKRAANQGWRTGARWLCMVFGLQYESVKGVFRRSGRQTEFEALSQEVDQYLQLIEAAGHNEDNLPEAYQERGVQLVLEAQELFAQVLGKPVALPPRYQIAANRLNARNKEGKPALATAAGSKSRSGRRQAERTTATSAAAESAQASAATVEVPMRDKAFEKAANEKLRALKAKHEADVSAIVDEANARLKQFQEEHKMTYDKKVKELRAQQHAELEQVRRELQEETLRYEDGKKQYDVISQLLTEAKAGLGVLSDGLQFIGANFYSIDQLIDKVADSQKELEHTDGEKLTIQHAFQAVQHTAQTQEQGAQAALAIRTRSAEMADVVAQLEQLLSGADTALSTAPGGSLFESQQQGYAEYLRAYRASVEESKEKVTNFEQEADAKLLALTYALEQLQSKALGNLGAVTEKLATEYSVIQTKAQELEQGYQDFFDRCQHVEEQAVNIAKSAVEDRATFGQLYSGLQNEFNDLQVALERQGENVRQLNTDVSNVEKIAAVFVEGLNTVTLSREALAQLNAQPVGEMTRFFTGYKNQVSVASSALQQRFQVTQDLRRKLDLLAREIRVLADPAALESLEAELVSLMSDMETKQRDYEEVDAEAKQARAMVQTLQKDLRQLEQRLTTERRLAGRQAGLGGAGASVAGGSRLGGLGASFAGSLGGGFAVNNEAVRELEAEIRQTKGRLQDAERDVKETQGRATLLERSIREIQRDIEAKRRILTEEQQKQERLQQLAAAVTGGPGSAVAGTLASGLRGSMVSGLRGSMISGLRGSMPSGLIGGSVGGGLRAGSLAGGVGVGSRAGLAGSMGLGLGSRLGGLGAGASRPGFGPGTDIPKPFTGGNK

SEQ ID NO: 300 - protein, 248 aa, Neospora caninum
MAMEGVPVPERTKTKIARDVKLLDKMKKAKEARAKKVHAQRHALKMRTYKYVSEYRKERENLIKLRREAKAKGGFYKDPEAKVILATRIKGINKLAPKPKMILRLFRLRQLHNAVFIKVNKATIEMLKAVQPFITYGYPTLKTVRQLVYKRGYAKVGKPGAHSRIRLQANDIVSEHLGKYGIHGVEDLVHEIYTCGPYFKQANNFLWPFKLSSPRKGFKSKRHGYNEPRKGDWGNREEMINELVQRMI

SEQ ID NO: 301 - protein, 291 aa, Neospora caninum
LSRLPTAPTTPAPAASTFQYHPVKMARPKTRSLAAFLLLVTLGSLLIASEGVQLSVSALRRLSVSAKRIATSGVGSANGPGVRNMVGAWNRFSQGQEENPPNQTRPEIKMNVQWAKDKPVIGSNGGEGKILEAARKIAHQHGGLLMNPGQIRAAMLTEFMNTLNRIDLSKYENLNADQQRDYEDTQQSINAMSPEQKAALISSYQNEKKKTGLARLLFKRKKDRMEKQMMMAATHLNQDRDEKGNLNRGAVGRAIQHANTRFEAEEKREQEAQQQQAQPEQKPEPKNDTRL

SEQ ID NO: 302 - protein, 134 aa, Neospora caninum
MAPVSTVKRSIVKKRVKSFPRFQSDRFKRVKSSWRKPKGIDCRVRRKFKGTNKMPNIGYGSNKKTRHMLPNGFFKFLVSNPKDLELLLMHNTKFAAEIAHNISSRKRREILERADQLNVLVLNRTARLDTAEDE

SEQ ID NO: 303 - protein, 165 aa, Neospora caninum
MSQPNLQYAHTGAVEDYYRLHEASATNRIPLAQEYFAERFQRDLNAPVIVHDREHPQPAPHTYIAGTPGPLHYGVPLSDGYDPGVYAVSNALFDTSGAFRSIPLKQGPVFRRRQRGDCQSEWSNAFVSRVDPCECGYPEETYTPYEVARYRDQYGNPHTTLDFSR

SEQ ID NO: 304 - protein, 175 aa, Neospora caninum
MVKKGEENPMRKIRIEKLTLNICVGESGDRLTRAARVLEQLTGQRPQFSKARFTIRSFGIRRNEKIACYVTVRGKKAEDILEKGLKVKEYELKKKNFADSGNFGFGIQEHIDLGIKYDPSTGIYGMDFYVQLTRPGNRVAHRKRARGRVGYSHRVTKEDSIKWFQQTYDGIVLNH

SEQ ID NO: 305 - protein, 221 aa, Neospora caninum
MLRTSLLLRFAGAPTVRSFTRGAVLSVSRPARGPGSPSPSTPATYSAISRASTPSLAQSGIAFRESVPDKVYRWLDITGFLTRWNNRKEWLLDLPPFGRQGTPLVTEFERKQEMFVSLNALVISIFALYLGVKGMSHLSYKGPTPSYEGFPGVDGRKKDFTMMSRLWFIEPKERCKECRWLDLECKKECFAQLKAEGHRLTVNGGNPLSVPRGKLEPPHFH

SEQ ID NO: 306 - protein, 314 aa, Neospora caninum
MFYGVVVKPGQTVTLSPEDGGEVLHLSQVCMPQPKDAGRTYVQVTQEGKTYSVCMLQKDKLEFTNLDLFLSTRQGISIKTEGGKNEVHLTGYFEPDAEGFDSDEDEEDSESDMEENVVHHAKKHIPTKGGKIEDLDGNDDEEDDEDEEDDDEEDDDDDDAEMKALTGGDDDDEDEDDEDENEGSEDDEDADDMENGIGEDSEEDDEEDEEEDESPQNKKASMGDKKRKALEAAQTSNKKAKPSAAPAKGQAPQKGDAAAYKSALVDFLKKNGKTPLATLGQKVKKPAGVSEKMAQFLKANASTFDVSNGVCSLK

SEQ ID NO: 307 - protein, 254 aa, Neospora caninum
MQSTAQDSLRSLPAEAVAGVSGKGGASIPGGQSETRMVFVGNKDIYRVPSNAMIPEMSCPAYMEYDAAGNPILIPVKPEDLEKAKAAAGGMQMQPEITGTTDVGAEEDGNVEDFAAAERKGSHPTGTQQSESVPAAEESLEEAEVDLAPRVLEEREQVLDEHIVSFYSMPSHSTIAISLSEDASYPQPLASFLPASPFITSDGKVAVDVYAVKADMTEPKELESLPKYTSMQQGLERRNTLLRSLHEPTAIELF

SEQ ID NO: 308 - protein, 340 aa, Neospora caninum
MVCKLGINGFGRIGRLVFRAAMEHGDVEVLAINDPFMSLDYMVYLLRYDSVHGHYPGEVGHKDGKLVVNGKSVTVFNEKEPTAIPWGQAGVHYICESTGIFLTKEKAQAHLTNGAKKVIMSAPPKDDTPMFVMGVNNGHYKSSDVIVSNASCTTNCLAPLAKIVHDKFGIVEGLMTTVHAMTANQLTVDGPSKGGKDWRAGRSAGVNIIPASTGAAKAVGKIIPSLNGKLTGMAFRVPVADVSVVDLTCKLAKPAKYEDIVAAVKEAAASGPMKGIVSYTDEEVVSSDFIHCKFSSVFDIGAGIMLNDTFVKLVSWYDNEWGYSNRLVELAHYMSVQDGA

SEQ ID NO: 309 - protein, 158 aa, Neospora caninum
MSFARAAALPLGVKGRSVFTGMCTFLRQRMGRLYDSFYYSQSSTKYVMVFLFPAGIFYTRFRADTKLGYHVFINEEGIYPDYSQNYFDTKWTNGRKFYLKDETTVEQLKAQIYGEKNVPDNVKVACRGRVFEDTDNVAMAVRAFCKRDPRLLLFHDNL

SEQ ID NO: 310 - protein, 475 aa, Neospora caninum
MEGGVAQTGEMENGAAVGAPLGGSSRPTGHMAPHVEIKLFVGRVPQSMEDAALRPIFEEFGEVKEAVIIRDKATGKHKNSAFVKMGSIAAADAAIRGLNSTRILEQSMGPITVKYATGEAEKLGFATSSCEPGQDQAKLFIGSIPRMMTEDEVRQFFSTYGTVEEVFVMKDNVQNTGKGCCFVKFAFKEEALHAVRTLSGKHTFEGCSRPVEVRFAESKAARQQQLLNQQGMGGPQGMRGPGRMGNMAGGMGGGNMNMGAPAMGMGGGAQMGAPNNSNPRAAGQWKEYFTQDGRPYYHNEYTNVTTWDRPQEFYQLPPAPPHMGGAGGMAAGSGSNSNAEGPPGANIFVFHVPNEWTYYDLMQNFGGFGNVVSARVATDRTTGRNRGFAFVSYDNVESAATAVNNMNGFMAGGKRLKVSVKKGEEQYVQHLLQPQNNPQGPRGNAGSGMQQQWGGYSQGGGVYGGSGGQQRFTPY

SEQ ID NO: 311 - protein, 388 aa, Neospora caninum
MEVVVAVRQLEAFLLPVRRHVLGGFSFFVAVALASALRTAADIGQHHGQGFSGPFLMTIPGGSWGLEQGACFVGRARNLVVTPLPRPPYPSPQPLDVTTVGTALCRWLDSKYAAHQALKTAWEKRHQEENGEIHYIPPSDRHAYNLFDHLASAFTMFTGTLPQEVFFLLAPAPTFNMPIETTQSDVTQVAAVAIHKAAASKMLQRQHIPTIMPAFPAWAVPFMFGDKAFTFHVKRADFWVRGFDCMLGSRLVVRWSRVDVSVCDYMAAKSNAKKAAADLAAAVISTVRLRVVGMDFFQYAAPLFSADMFDEITNQVSLIPIRMYLTTDPQLTHEYETARSISTAIQVGQAGAALVQNFVHRAREAKPQGEHPHGTAPGMRGSTNAGPR

SEQ ID NO: 312 - protein, 377 aa, Neospora caninum
MNISNETPVIPIFRILDYEGQIAEGWQCPMSNEEVLEAYQFMVKLSIWDNMFYSVQRQGRISFYIQNQGEEALQTAVGLALDKKDHLFCQYRELGVLLLHGFTAEDALEQLFARRGDESKGRQMPISYSKHNVNLHTICTPLTTQVPHASGAGYAFKLGGEDRIAVAFFGEGAASEGDFHAAMNFAATLKSQTLFVCRNNGYAISTPVKDQYAGDGIAIRGISYGMRTIRVDGNDLFASFLATKKAREIIVTQHEPVLIEFMTYRVGHHSTSDDSFQYRPSGELEAWGQSARLRRYLDNLNLWSDKQDEELRKEARSTMLRMMKAVEKNKRCAVIGGVFDDVYDKEPWNLREQRESLKEFMERNKQHYPQLKEYESI

SEQ ID NO: 313 - protein, 521 aa, Neospora caninum
MPKPAYRKLAKQYHPDVNPGNEEKFLDIAKAHEVLSNEEQRKKYDMFGEAGLGEGGGPSPDGSGGVPVDFADLFGGMFGGGAGGPNIKITFGGGDGPTFSGAPEGFGNFFSGGGHSGGFQEAPSNNASLYDAEDDEVTELGPQAVHRLIDGRDFVFFLALYNPRCRPCRQLKDEFVKAAKRMKGIVPFGAVNCSRFGNLSYCQEAQHYPTLLFFPADKHSKRIDYRGERTAAAMVRFLSENLPSTVVVLTDESAETWFSTDPQIPKVVLFTDKRGTPPLFKYLSYQMRSQVAMGVVFKNQKNLLKAFGEGLEYQRTHQPPKPGAKPLPAEIIFPSLLAIDDIDRLTGEWIDVKNHVNQELLTLTLSRLAAKARTASGVSFRELTARRMASGECGKDDSQFCFVLLVPDAMGARQAPKDIFAKLTELSEKLKRDPLKICWVNKDTQPGFTRVFSLPVDQEVVFLAYRPKRKKYEVMTSAPTPSSVESFVNDVVSGGKQLTKKLTQFPQLARKQAKVPGHDEL

SEQ ID NO: 314 - protein, 685 aa, Neospora caninum
MHSRSENAARGYTMTGRTTVSGNAVYLAPGFPGAPTAAYASREHILTDGTPSAQAFSTASVAGFSETDCEPQRKSTDVHWLLVFGGCALVTFCFLLLAFAEGSPSRLTRGLNYQGKTCGVDASVRDLPFLYVPLDPRERYASLMLDDARCVAECPTEQDVEAGKTIPVPIRETDTDPGRASSITVQFALQSPAYAATLMAGAYCVPLDTTLRQQIGTILNSHFRQIQVALGSFRAAWGCVFGYTLLAALFAAVFAFLLRLSPGVVLGVTAVWAICLAVVAGASLVSNGLSGVLDPDKGNFYALDYSWALLVGILLIAAGGLMGLLLFAARRAVGNAVRLLECAGEAVFDMLQIFLAPIIFGTIASLWMWFWLEGYLYIVSAGTVDKTQVTSGIDPNGDVDVLPLHRSMVWDARFILFGIAWWFALFWVVEIVLAFCQFVIAYSATVWYFSPPEGAEERDVGWYPPLVAVGLGARHHLGSFAVGALVLGATRPLRIFFGWASSKSLSLHRHSPIVQSLTDCFRNVMQPITFVVDRFTSSGFIEMSISSRSFFPAMDKSCSRILNSRSPAAYLHGVANICSIIGTSAVSLTVSFMCYQTLTGTEKYASLTSPNFVAAPLGVSLFVAFIAAVISSQYMAVWDTVADTFMYCFLVESVQPPVVDENPITKVHAPACLRELLLDAQQEMM

SEQ ID NO: 315 - protein, 762 aa, Neospora caninum
MTALQVQKGDVVLLSGRRKRETVAIVMPDKSLEARHVSLHEHALKHIKLHAQDVVKVTPQRLLPHARRIFVLPFSDTLADVRDGDAERGETKDASRGDRDGDKPSVEEVAAKFFRHTSRPVKLGDQFVLEFPKNAKGDRGETAGKVEVKIMQIDTDGKDDQDLALVDDATEIICDGEPLDRAQFDTSSMITYDDVGGLKKELTLIRELVELPLRFPEIFKQVGVQTPRGVLLHGSSGCGKTLLAKAIANECGANFLTVNGPEVMSKLAGESEANLRRIFEEAAALSPCLLFIDEIDSIASKRDKTQGEVEKRIVAQLLTLMDGVSSDKNIVVLAATNRPNQLDPALRRFGRFDREIEIPIPDEQGRTEILKKKAAKMNLGSDVDLEKIAKDAHGFVGADMAQLCLEAAMQCVRENCRFVDFDKDEVDPETLAKFQVRMPHFVHALSVVNPSALRERHVEVPDVRWEDIGGLEEVKEELVETVQYPVEHGEKFHKFGLAPSKGVLFYGPPGCGKTLLAKAVANECKANFISVKGPELLTMWFGESEANVRDLFDKARAAAPCVIFFDEMDSIAKARGSGTGGGGEAADRVINQILTEIDGIGKRKPIFVIGATNRPDILDPAVTRPGRLDQLLYIPLPDFKSRVNIFKAALRKSPLAPDVDIEDMSRRLEGFSGADITEICQRAAKNAVRECIQSEVARGRPLEKGEKDPVPFISKKHFDEAFKYARRSVPEDMVKVYAQFNSMMKRRRVAEKESEETKDPNA

SEQ ID NO: 316 - protein, 1870 aa, Neospora caninum
MAAERKWADFELDDDYELGDLVNTATGFETKPDEEGIKTVTTYTQTLRGETLKVTKRIKVIRKCQRINKEVYARKNIVPFGLDAEDGDPSLRATTVRSHEEIVIEVPRSSKQRKFKEEEEDDDFYMGDLNPSKTSRDLRQKFRALREDDDGGAAGGDGDEETGLRSGGAGKYIPRARRDGETLKDVENRRREECTIRVTNLSEDVKDEDLTELFGKIGKIDRIYLAKHKEKKCSKGFAFITYQRREDAVRAIRQLNRHGYDNLLLNCACGHPKITVGILLTLLGILLTLFAVYIHLRLHPRRPDAAVSCGAHNTPFSLIRFQSHSDLVVALWEKLQNAHNSRVNGDEVLPSPFLGFANEAERNEAEVPKSEEDVTWPLGKSNRGEMDKRRRPSREDQLVPAPTVLPPPGGLRGKTEKRQAPPHLWSVSAGPAGDRPASPARPTKFAFSSSPSLAGKLGSSPWKSREANKTTEASEAADPLQAKTEGDEGGRTGEDEGREARDSRALEQEVDLVTQAATGGSSSLFSSPQAASALPGKSSASSTIRTEQERRGGARSGPEGTLFPGDRNPRKETDAREQEGILGREKKEEQKAVEGIPLFFPFSSPRGKPSSSPLGAAEKPALSCLRPQNRDEVPNASQIQHDLRLCLSAYDARRARSRMQSPSKKRATEKGERDDAGRGGSAKRDARAGHRGETNSEEAELGKGRTRGEQREEGDSSRTLQSEGEEKEENAESSGKTTSESREREKEPDAEDEEMLPPSETSLRLPLGSTSPSLQVSNEKQSTKDEKLATPVPGHSGPEKRADDALGLNKNQAGVERRRDVLHGLPSSPDACLRPGLPPALRVCTESQSFAFCRFVSAVESETFATARQLSLVSAPSEGNEKRAVSPNVAEKDQSPSASEFVKSSASFPLSPCGEGSRSAGGERGGDEHECSHKQSTVSVHPRQEAKEDREEDRDRESEVTEGEESKDTRRNGTGKGRQEETDSKGTATEAEKGEKGERGKGEERYGKGEGEDGGDREAAASFGWACCLQKSPLVDPVEETSWRCDENPQRDRGREAEEREERERTSKDGARSSPFSSACAPLHALPVALSQPSPHSSEVTGQPAGALPPSPESLARRYRWRRVYTVGISASKDRWSYGREALRSMPQNKGGIWRQRGRICLRARRREGSRVGARGKGMRQGHLALGKAKSEFFVSASFSEARQASSDPLKGRGTRPTEGSARDRDSSEARQPETTKDLGIHFREEGRESEKSPSSQETESREKMESREETESRKETKTREATETREETEAREETKTREETESRRKMERKKEAAETGGLHGMPVGDSRGTLLASVSALREQEALQGDRETARLVRGAVLPDGPRSALGFQRLAFSSAVLKTIESRDLPASVAGREMPNHPPLETRPVLSLTGLAICEASPLLLAPRASAGRPSSLSVSSAHPPLPSPSSPSLPPLPSPSSPPLPSLPPLWVLSPRLPHASEEAEMAGRTAVAAPAEGGRVSAAMSVDDSDGENATEAAHVEGFVFSPVERGANAPQARRGRGRGEEKGMLKTATGRMESHGENRVSEWRWRGEDEGEEAGERTEKGKAVARWATLSSPPGEKEEESEGCALCLRSHRERCAYRRVRSRRHSRGGCEEEIDELTEEKGESRTEKGRSREQGTDRNARLTETKTERETGERERDSGKSSLSGSGQSHREQCHCQPQPQLEARRQEKKDSERETERERGREKEREKGEKGEREGTPRAMCRKARICRGGREVLGVEVLSSYREHGLDEMCEEEREGLAANHHQLVALLNKRLVEGVAHTGAGRGDRGRDKTRAQKTDSGSSLFRHPSVRDLRGNSPRKEKCGRKSVACSKATCEHFAYRRIGE

SEQ ID NO: 317 - protein, 4864 aa, Neospora caninum
MERQKIALSNFLLEICPALLNCSRQSLQSLLAKEADRTLQTFLLEQQQVLVVGREPVAKKKNGAPGSGAEAAPPGDRPEEPPADENDEEEQFRLFVELGFAAHALTRANSVAFLKRPGFSLEEQEPSPEVGDDEASPAGESVHHAPMHARKTIGQQLAVMRCGFGEEAETSLDVTQLYMQRGLAPMLNVALTQKETEGTGAPAGGAQAGGNGSAAGGQEEAAEGPAQNKVASSSLHQTVNKKMAELLLAVQQAQQNVDIPLVQLAVDPVIEAAVKTAQAAGRKATVEDLGDYLHNTGYLIALQNHVNRWIKDIQKICRMQRDASTGSAAEEVNFWVGMERAISHVEEQLKTPEAELTLQVLKQTRKVFATMTFEQDAGLKQASDMVASVNILIRDFPVNDLLGATSVEQLTQAVRTVFMHLRKLKNATQYPLSRAYHLVEALSRDLSQRLVAVLSQQHLLLLSFEEFEHATGGCSELFRTWEEEVRQFKEMVRDQSKKRGLSERPPAKLVCEHLVIQERLGELRQFRRQHHRLKEVISKVLSESAGGDLTAQKEVASAYELMQSVDVLDLSRAGQEAWEAARKAYDDRIDRVESQITARLRDRLGASTTSGEMFRVFSQFNALFFRPRVRGAIQEYQTTLIQQVKMDLRKLQEAFLDGHQRVETLTMAEARDMAPIAGSIVWERQLERRLEGLVRRIEDVLGRGWEQHVEGQKLRQDIDAFKQRLSQNQLFENWLQMVKDEKRLDASEHIFVIRVLGGKGFELDVRLLNTLQFRIPYSVKVMADEAKVLYPFVTTLRVVLRTYAEACRRIECAPSPVSAGGMRTRSGDSIIALLVASYQREAQQRLAEGMGLRWDSDRLEAYVRKVSDVMYSFEGKVDAGIKRHQDALQDMDAIKDMLVKVQKHIEEQQLQHFSNIPRWTRLLDRHVETILRNRVVDTVNAWVKQFEGWPHAGTSLVKKPAVLEIQLRNQVLQVFPPVEAAHQYWMGELHNTIASVCLLPRLSSRIGASAAAFDEFDDSGSSDEEGNGKDESLQRPKLRKDRTYRHLSQLVDPTVFYHAYDVINAHIQRVKAYVQTWLQYQVLWDVDVNEVIGRLCDDIETWQHLLNEIKAARSTFDTHENQEEFGATVVDHQQAQAKLNVKYDGWHREILHAFAQKVAARSEAFYKHLHSLLTDLEEQGRAEDPTETSISAVTFLSMSQFQMDAFVNDVGPQADALLSSLVSNLTRFLLKLQEASKADVEWGAAVESLRASERLLEGQRFAFPSDWLWIDRVEGELETFQQILHHQALLVEQNREQIVDMVKRYNDRVQFRLSHLYSEWMTHRPVKSDVSPQHATQVLATYETQLTQLSEQYAFGSKAKQVLGLDDLAQGDEEQFTPDSLAEEIRDMKGVWSALGSLFDDVSALRDTPWASVVPKTVRQRLEELLEKIKTVPSRFRQYDAFEEMRTQLTTFLKLNLLITDLRTDALKERHWKLILGLLKIKKPLQDVTLGLLWHADLPANEAAVREILVQAQGETALEEFLRQVKDSWQDRELVFVAYGTKTKLVKGWEDLFQLIDDQLAALQSMKMSPYFKIFEEEALTWEDKLNRLRSLLDSWVEVQRKWVYLEGVFTGSQDIPMLLPQEHHRFKGIDQDFKNIMKKAANVKNVMEVAAVDDLGRQLERLSDLLSRIQKALGEYLEKQREQFARFYFVGDEDLLEMIGNARDVKVVQRHINKLFAGIAVLDTDPENGAIIVGMSSKEGESVPFSTTIPILQYASLKEWLGAVEQQMIVTLAENLASAIAQLEQVNMPKLLASCQETDGAVTNHPFLLWIAAYPLQALILALQVSWTRSVEAALTQKRGEEPHPLATDVLDYTCNLLGFLADRVVMDVGVTVRQRMVQIITELVHQRDVCRVLIEQGVTAKDDFRWLQYMRFYFTPPTQNALPQNSLRIAMADATLSYGFEYLGMAERLIQTPLTDKCFLTLTQALNMKLGGNPFGPAGTGKTESVKALGTALGRYTLVFNCDETFDFNAMGRLFAGLCQVGAWGCFDEFNRLDEKILSAVSEQILTIQTGLREGLSSIELLDKKVKLSPNVGIFVTMNPGYAGRSNLPDNLKQLFREIAMIVPDKQLIAQVTLFAQGFRSAERLASKIISLFDLCDRQLSKQPHYDFGLRSLKSALNSAGSLKRQWLQDRLSSVEGAESAPEESEASVVKVEETLLLRSVCDTVVPKLVAQDVPLLRSLLAGVFPGSDISMLEEKVLCEEIERLAQRRHMQCKGEWKEKILQLYQIQKLQHGVMLVGPVGTGKSAAWRILLDAMERLDGIKGHAHVLDPKAVPKEQLYGRLDSTTLEWQDGVFTAILRKILQANAQQQAGSAPGALKRHWIVFDGDVDPEWAENLNSVLDDNKLLTLPNGERLQIPSNVRLLFEVDTLKHATLATVSRCGMVWFSDSVVEVSTLFRHHLSKIQMGSLEGTQAMQKLGRLPSQKDDDRETPEKELTRSESSASHGQGGVATLRTGVEAEKAQLCDIAAEVWRPYFEKDGFVCEALARAMSYEHIMVPTHVRLWLLLAMLWGFGGSMSLANRLNFTKEIQRLSPIRLPTALDDADGRDVTLLDFEPSVEDGAWHMWKEKVKQVEIEPHQVADANLVIQTVDTLRHKHVVEGWLDEQRPFILCGPPGSGKTMTLTSVLKERTDFDIAFLNFSSGTTPQVLLKTFDQYCEFTKSPKGVVIMRPTQPGKKLIVFCDECNLPSPDKYGTQSVITFMREITETGGFWRLMPQMAQSGPWVWVKVERVQFAGACNPPTDAGRHPMSDRFLRFAPLLFVDFPGTESLRQIYGTFNRAMLRPFPQLRAHAEALTNSMVEFYDEFSRAFTVDMQPHYIYSPRELTRWKLAMAEALEGGDRVLQKTGSRVLKGERDQTAGVSNFFASSLVDGARGEDSGRLEPEEVDVKMMVRIYTHEGLRIFSDRLVHEAERQKTDQMIDEITLRHFHGVDPSALQRPIILTSLVTKRYEEVSREELRALLQGKLRVFNEEVFNVQLVFFNEVLEHVTRIDRVLRQPLGHLLLVGASGAGKTILTKFVAWMNGLSIFQIKAGRNYNTAAFEQDLRVVMKRAAIKEEKIAFILDESNALGPAFLERMNALLASGEVPGLFEGDEYTALINECKAAYGSGEYLSNESGEIFARFTRLVQRNLHIIFTMNPANPEFYNRQATSPALFNRCVIDWFGDWNERAMLEVAKAFTSPILLPPEGFEPDAAVGVNIEAVENKKTETGEDASGPVDVDDEARRVRLATSIVAFHAAVALNNKKLQRAGKKSNWMTPRDFLDFLHHFVNLVGEKADATGEQQRHLQAGLQTLRVAEEQVAEMRTELTEKESVLTEKNEEAEKKMGQMVEQQAEAEEKKRGAEQLARKLDEQTGVIEERRQVVQKQLAEVEPLLQEAAEAVTNIPKKSLDELKSMANPPAMAKIAVEAVALLITDAGEKPLSWEDARKVLKNQDFITKVVNFDCSCVSPATRRCVQSKFIHGGEWDLEKINRASKAAGPLAKWVESSVAFVTISEQVDPLQKEIEVLEVEALKNKEELLQQQDLIGQLEAKLQQYKKDYAQLISQVQLIKREMEDVQKKCARSMRLLQNLGSEKGRWLEQSDALCQAGFTFIGDSLLAAAFCAYLGFFEYAHRQRLLDEWQQILKVERVRFCADLSYVDFLSLPSERLQWVACGLPPDDLSIQNAIILKRFLRYPLVIDPAGQATNFLTHLMAAKKLTKTSFTDQNFLKALEAALRFGTTLLVQDVEKVDPILNSVLNRETHKLGGRELITVGDAEIDLSPAFMLFLATRDPTAQFTPDLCSRVTIVNFTLTPSSLVNQCLNLILKSERPDVDKRRTDMLKLQGEFKVKIRELEDGLLQALSNVKGNILDDDAVLATMENLKQQAAEVEREAARTEDVMAEVEKTSNMYLVWALAAGRIYFMLLNLSCISFLYQYDLRFFLNLEKVGSSDYAARLEFLMEKLFSTAYQRLAPGLRYSDRLVVGLEMAHIRAEIDLKASIWSAEMQLLLAGTILKGKADGEAGDESPAEKRDEERREWKDDLDGGINAEQMKALQKLSLLPFFAGLERQMGEHRDAFKAMLSSPEPEKLVPSGVLAAESDDDGVFGVGGKMTKAKWLRQLREILLVRALRPDRVSLLLAALVEAVLGENFLTVPELTQAAFYDLIQTQAGAAVPVALVSSPGFDPSLKVTALAAAYNQPLTSIAMGSKEGFLLAEKAIGQASRQGHWVLFKNVHLSTKWLQGLEKQLYRMQGVHSNFRIFLTMEATPALPLNLMRVSYTFVFEPPSGVKASLLRSYATMNAESAGSAAKKGLASPDPGVSVGKPPLVARSRLQFLLAFLHAVVLERRRYAPVGWCKKYEFSDADQVCALKIINSWVDAVAAVGKGAPGDKMMAEFIAPERLPWEAIRTLLKQVCYGGRLDNPVDQKILSSLVDYLFQPAAFDASFPLNIMAESEETGSDSLSVPQLLTAPDLFKQPSAYEAWADQLWSVDSPTWLGFSAHAERLLASRQSLAAVGSWAAVLLRGNEEAHDFQAIAVQGSVAPGARQQTRGRGDEASLSAQLTSQMSSEMAGAGGSSWLSDLLPGVQAMVNMLPEAVPDMRRTEETVKDPMFRCFERETTVARRLLATIHDALAQLVLVCQGEAKLTNALRDLAQHISSSEVPPEWKNVFTSAPELTLAEWIEDFSRRLKHLMLVAQSFGPNAIEDAPKRMKPEELSAALSRQSDGGELTQRRVWLGGLLYPSAYLTASRQAVAQAKGWSLDDLAMEVQIGVGEPQDDQSFVITGVTVEGAAWDTQGKCLTLTESLKASLPPVAIRWWHKDEGPKMVFSNQTPLDVPLFLNHSRA

SEQ ID NO: 318 - protein, 165 aa, Neospora caninum
MAPKFDPSEVKYIYIRQVGGEVGASSVLAPKLGPLGMSPKKVGDDIAKATVAWKGLKVTVKLAVQNRQATVEVVPSASSLIIKELKEPPRDRKKVKNIKHSGNLSLEQVFTIARTMRSKSQACEFSGTVKEILGTCNSVGCTVDGKSPKQVQRMLDDGEIECPEA

SEQ ID NO: 319 - protein, 211 aa, Neospora caninum
MFTGKRWILVVAVGALVGASVKAADFSGRGTVNGQPVGSGYSGYPRGDDVRESMAAPEDLPGERQPETPTAEAVKQAAAKAYRLLKQFTAKVGQETENAYYHVKKATMKGFDVAKDQSYKGYLAVRKATAKGLQSAGKSLELKESAPTGTTTAAPTEKVPPSGPRSGEVQRTRKEQNDVQQTAEMLAEEILEAGLKKDDGEGRGTPEAEVN

SEQ ID NO: 320 - protein, 167 aa, Neospora caninum
MRPLQALAASSRLPQLPFFSLSAPRLGGNHIYLGRYHDFNNWEYLPHPKLQKNGAIKPVGSQQFNPAGKELRGSGLHGPENGDFFRLMLWNRLRQKGMRREVPTLEQMREYNRMDVSLVYFCWGLILFLYPMALYARSYATEHGHFPYAPARTDGSRGHGPLWWFIE

SEQ ID NO: 321 - protein, 199 aa, Neospora caninum
MVLLERRDALERSAGGVYLPSESKAKQVIAKVLEVGPGDINRDTGARIPVDVAIGDWAIISRHAYDSFKYNGKDCVLVEARDILAKIQTTTEERDANPSDILPLGDTILVRIVKQAERTASGLYLHQPSSDRSRGQGVKRAHVVAVGPGRYNKNGERVPNDVVPGDEVLFPSYSQDEPDMKYGGESYAFVRTADLLAKW

SEQ ID NO: 322 - protein, 363 aa, Neospora caninum
MESCHAYHGQIKDGLFHGKGTLIYSGNEKYEGEFVFGKREGHGRFLYADGATYEGKWVEDRIHGQGVAHFASGNRYEGQWEMGRINGFGKLSYSNGDEYEGEWVDGKMHGRGTYRYAEGDVYTGEWRDDKRHGKGSVTYVSAKGSVVEKYEGDWVNGKMHGHGKYIYSDGGVYEGDWIDGKMHGKGTYVFPNGNVYEGEWAHDMKDGYGVLTYQNGEKYEGYWKQDKVHGKGTLTYTRGDKYIGDWMDAKKHGEGELIYANGDRFKGQWADDRANGFGVFTYANGNRYEGEWADDKRHGHGVFYCAEDGSAYEGEFVGGRKEGSGVLRLATGHQLEGTWSGGQLVRVTSFMFAQDSPWLNVDL

SEQ ID NO: 323 - protein, 252 aa, Neospora caninum
MASPFLATRRVFASAVPRGQLSLLSSLSSLRSRALPHGGSLACFPPASPLSAAPLFSSRRAFSSAAEESGASQTLEGRYASALFRVAKRKNQLEKVYADLESVRNALKDSGEFRLFVDSPAVSVQQKLDVLQQLVNRYKFDALTGNLLTTLVENKRLPILARVADAFDAMYRKEKGEVKCLVTSAKPLSAQQQKEIVAALQKRAGSQARLIVDYAVSPQIMGGLVVRLGEQVLDFSVVSRLDRLQSQLLAPL

SEQ ID NO: 324 - protein, 169 aa, Neospora caninum
MPSRNARLQQWINYRVRVCLQDSRMLVGSLLAFDRHMNIVLADAEEFRKLKIRHKLADGKHQTEEKEVKRSVGLMMIRGENILTLTAEAPPPAKPKTVSGPVAPGAIPGRGVPVGRGVSLAPVAPVGLAGPVRGVGGPAPQLVAAPLGRGAVLGGPSMPMMRPPMGMPQ

SEQ ID NO: 325 - protein, 279 aa, Neospora caninum
MKRQQPDRNNSEAACQKQRRLEENPDVKGTGCCCSSEEAAALLQPHMQDLDGIQAELQKLEEECAKQQMVVQKEFDEKKKPVLVKRQEIIDKIPGFWCRCLRNHPQLAYLVEEDIPVLEHLKRIDLDDNIDEHGSYKIKFTFDEGAKAYMEPLVLEKHVQFHNDPCSEEVVSVTEITWKEGKSPVAAAEAKRAGDAEDDIDVVSFFEWFTKKPSEAAARLEVGEIIRREIWHAPVPYFLDEVADIDEDDDEELSDDEDEEDGSENANEGDGDEDDEGDE

SEQ ID NO: 326 - protein, 368 aa, Neospora caninum
MDHKKRLASRVGTPGICTVVLIDKTQRPIMNLHKVPLSATIWAIKTKVSERLKEVGRSLSAEAMVLHVESGGTSTAMDNDEFLSTYNTLGVSRFTVIISRRTKMELQVVLSRPEKKCLCITKQKKEQEEFPVHIPLAYTTHQLRLYITETMNCNTPKKDFKLYYDEAMQDAFPEEGVVGSLGIAEKTRLYALMPPGFDITKIEYPVIEGKKQDAVATAEPETLTEAAPTAPAGSEKSQQEKEFEARAMGGLMPQQDAGDYARSLGFSPSKKEVASLPEKVDYKAFQDFLGVAMHPDDTQESFRIFFSSFDNQGTGDLSKKQVCNILQMWGDEPLSPAEAAAFCELVMGKENSISIKVLVDIANVCWCA

SEQ ID NO: 327 - protein, 325 aa, Neospora caninum
MIGAGARKSVTQGVLVALVAFVCVGAAQASRNLEPNTCVLANNGAQLSLENQTRLALSVTQAGQQITFTCPDGAPLDPSRATVAGRYYAASADGKCLSSQNTLTLGNQVPGAYVSMVKGTGITATTYALFVPVLPPTAQTLCFLCSGKANHKQDCPIVVDVAARKAVRSSEGKSFFQEHICDGEGEKHISVVEPQALTLQCGTKTPTLDPTVKLAQVYTGADCSGKATLATEISGATLEEAKSKPEEQNQRTQTGYVLTVTQMPETTKQICLKCIGTDSPTPKETCTFKIAVGKNGGSASAGFGLSAVTGVAVSVFVLATASLIQ

SEQ ID NO: 328 - protein, 281 aa, Neospora caninum
MSRSNMSSPRGSTHGQPESGGFRLHEAEAPAQKRPSLMVEGKPHSRKLSVGFADSFEPTHELKEQQDSRRRRIPSHESNVASRTASISSAGNPSRNGSAGFSFVRRLTSYLYGIPLGFFQSRAELRTWGEEKLTDPSVQPYSQRPMITPFHQTLPGYGKDAVMPLRRELMGKQPGPFYTLAPKGGFVYNPHHPNMDFSRVQIEYPTRTGDFKPPMYEWTSMPEFKMTDRPYTSARLLPANPATMYVSGNYMTAYPYGVPAVEENEGGVRVPPSSRRCRFLC

SEQ ID NO: 329 - protein, 522 aa, Neospora caninum
MAGCLFRGLSGQCGPISWSHAVLMLILGVAITSLNRTQAFHRASLHGTATPEDHRMLQAQYLSSIGARETVARAHRGAAFQKLLGKDRARPHSLIQEVAEEKNNSNREVGSIPRFSALPESEWDYNQHGKDWGGMCAKGMQQSPVDLHIEGLQEPEYRNLTNLYMNAFSGTMVQSRPFKPWKRGDFFYTYPHQFTQVDVYKSSKVFQVRIPEDQMTPLGAMFSTDTAEMYTAQHIFFHSPSEHTFQGEANRREIEMQIWHYSNDLLSFESSTSLNHTSLPFLALFAQSSLNLPDVEEALRRDQSSGADPNLPSSHWRVISLTFMSEELDQTSLAELKSLPSERLLSTLLSAERINSEAGQSEKVQLVHPLNLQSVMMMLQLTNTEFFAYDGSTTMPDCTENVRWYVARQPLPVATETMLRFYKMLNPQQLKSREEKDGNFRMLQNVEDNMRNEGNVFLVQGFPLQVLVANSLGFDTMAKMSKEGSEMFQGWFTAAGAQTFGYSGTALAYVTACLVLLNAVGL

SEQ ID NO: 330 - protein, 472 aa, Neospora caninum
MYITQQKAHLSDRYQRVKKLGSGAYGEVLLCKDKLTGAERAIKIIKKSSVTTTSNSGALLDEVAVLKQLDHPNIMKLYEFFEDKRNYYLVMEVYRGGELFDEIILRQKFSEVDAAVIMKQVLSGTTYLHKHNIVHRDLKPENLLLESKSRDALIKIVDFGLSAHFEVGGKMKEPYYIAPEVLRKKYDEKCDVWSCGVILYILLCGYPPFGGQTDQEILKRVEKGKFSFDPPDWTQVSDEAKQLVKLMLTYEPSKRISAEEALNHPWIVKFSSQKHTDVGKHALTGALGNMKKFQCVYRDMEPPAMLFMGSKLTTLEETKELTQIFRQLDKNGDGQLDRRELIEGYRKLMQWKGDTVTDLDSSQIEAEVDHILQSVDFDKNGYIEYSEFVTVCMDKQLLLSRERLLAAFQQFDSDGSGKITSDELARLFGVTEVDDETWHQVLQECDKNNDGEVDFEEFVEMMQKICDVKVKH

SEQ ID NO: 331 - protein, 529 aa, Neospora caninum
MDQAGEERPHFEHISNPGSLFGCHPQSTGWGPSSCDKEVRSECLAALAHLPFEPNVRPSLFSHQLFRACDFTFHVQQARFARIHARHRAFSEWSVQPTNEWAVEAEIPLSQLYKHAVESGKIKVKDLAWRGELRTYNKQADQIRTKLPVALQNLSSNFDYYWVTTQDDDLIKEQMLNSSEPIDVAATDQVLACLMAAPQSKYSWHLHLTKVEGKLLIDKANGSIVDLLTVNETASEPPMQDAENRLNRPAALGFEAVKINQNLRQQLLVKGEEPVKFPPPPFVETGDNPASIAYRYRMFTIPGRTAGTGGGKSRQPINIVTRTEVNAKLPQPADGSRKPTPGDDTTTGGHNKREKEDSDPFGKDGGGYVYICALNEYDIKGQRNWRVQMETQRGALLATEVRNNACKLKKFVASAMMAGCDDLKLGFVSRKANNDNEHHVVLSVQSYQTRDLGLQIGLKPDNAWGIVRAIVDMVMEKPDGRYVLLKDPTKPVMRLYSRPEEEDEDAEEEEEKAVEPRTEEREANRNEEE

SEQ ID NO: 332 - protein, 339 aa, Neospora caninum
MPLGRLLFGSQLPTQQWRSVFGGVHPTLARSAQKRFFSGGAAKPGWRVAREHRFGPTLPDHAYYGEHATFNYFVLFIRGMRPYLEKVLGDCALTIKNAALAVYRPVTAFVVKHNPELRLQFVAFASFMATHMAITKQFNDMYQRLVDVTSLLELQAAQLHASEGFWESESEQQEARLQRHAEHMKDLETTWEEALREATLSRNFDILVRSLSHGLSDGCGEHGSDCTEGTEREGTHGAHAKAGHGASDAHGCFGKSGQNGIPPSLMWNFNAMPYGKDNPDTKTFPIPDHEQPYRAFSLGFTANNLSGNWGDYIDRQDNKNALMRPARMMFTDVFIPTTK

SEQ ID NO: 333 - protein, 271 aa, Neospora caninum
MTERLLTTIGRAGVLLGSAGFVASSCLYDVDGGQRAVMFNRFGGVAKKPIGEGMHLYFPWFQVPFLYDVRIRPKVINTTTGTRDLQMVSVGLRLLYRPMEDRLPIIHQTLGPDYDERVLPSIGNEVLKAVVARYDAESLLTQRDKVSHDIRDAITNRARQFDLVLDDVAITHLSYGKEFSKAIEEKQVAQQESERTKFIVARTEQEKKAAVVRAEGEAEAATLISEAIKQHGTGLIEVRRLDAAKEIADTMAKSRNVMYLPSGVNMLLSQQ

SEQ ID NO: 334 - protein, 669 aa, Neospora caninum
MRYPLDSSRLLLAFVLLFSRLVCLHLPSVSVDAVLHSSSSSFVGPLTMPASVAPSGRPVSPHYAPNQVHASEASFAATTAAPTLPSGVSLASSLSAAAEERGRRAGRKGRSRALGFLASSSPFSHSCTTEQAGQLFSGDAKVSALRIQASTSRVGRELASSLRSQASEPEIRQLAASPIFGAAKTFSSSCPSCSSPSRTSCASHPSALLPDVCSFVSSQRRARGVPGDNRGVGAQRQSRLAGAPGQRLRASAGQPGGAKGQARGMKPKGGMHQEPLRGRLEDDEEEEDDYEEEEDEYDDESEDEYDDDEEYDPMTPRGPLDNNNYGEVWLPIQARPRRNRKNRAVRQLVQENLVKPSSLIYPLFIHDEETSVPIPSMPGQKRLSMADLLKEVGEARSYGIKAFMLFPKVGDDLKTVMAEESYNPDGLMPRALMALKEAYPDVLLLADVALDPYSSVGHDGVMDEESGKIVNDLTVHQLCKQAIALARAGADMVCPSDMMDGRVSAIRESLDMEGCTDTNILAYSCKYASSFYGPFRDALDSHMTGGTDKKTYQMDPSNSREAEREAEADVTEGADMLMVKPGLPYLDILAKIREKTKLPMVAYHVSGEYAMLKAAAEKGYINEKEVVLEVLKSFRRAGADAIATYYAKEAAKWMAEDMKGAQKFTEPCY

SEQ ID NO: 335 - protein, 580 aa, Neospora caninum
MATPFLPLDSNVRLEEPKGKLTVPEGTLVWNLNQACDSKGWGGVSPDVALRLTSFCDGRLQALEPIDGRSAPPEFTDAVTGQYDVRTWRKGELLLSIEGEKSVYLKVPTIATVVSWTSPERLPVLTKSWKPAIFLLNSCYVAVRYIPDSVLLLTRPDESSTAWNVTPVSYGRGFISLDPCNEKVISYGSFAIPEAVNTLALPQQPGPSKNDFFIQYFPWGLLVIPKHIDISKGGLCGGGNSKLAMVIHPPNVFITVQLLFPAKLAKTLQYETDFVITAKKASESDIVIYLIVDGQLVSYDYSFDIRINKPEKPPVNVLAKFKTFFSSDELTKIKAAKADKKPYNPRITFAESDVQKVIVQEGSPLSQGHLLTEQTAAVYDAETGMYYSNPIGMKLTKVFKEVVVPTPKKSSEKPVEADPTASSSPTTNAQPAAETVAAPNAPSASTEEPAAEPSATPNAPSASTEEPAAEPSATPNAPAASTEEPAAEPSATPNAPAASTEEPAAEPSATPNAPAASTEEPAAEPSATPNATATSPVEGENKLGTAAPANDKEVAATQDQGDDVKKPAEDTAADGLPASQ

SEQ ID NO: 336 - protein, 415 aa, Neospora caninum
MDSAAVWGDEGEDVATAELAGLTAADLRMRTSMIDSEVRILKSEERIKDNQEKIRLNRQLPYLVANVVELFDSEEADEEEEDGAVGDIDAQRKGKCVVIKTSTRQTIFLPVIGLVDHTLLKPGDLVGVNKDSYLVLDKLPAEYDSRVKAMEVDERPQEEYNDVGGLDKQIQELIEAIVLPMTHKERFEKIGIRPPKGVLMYGPPGTGKTLLARACAAQTKATFLKLAGPQLVQMFIGDGAKMVRDAFELAKEKAPAIIFIDELDAIGTKRFDSELSGDREVQRTMLELLNQLDGFSSDDRIKVIAATNRPDVLDPALLRSGRLDRKIELPHPNEEARERILQIHARKMNVNKQDVNFRELARSTDDFNGAQLKAVCVEAGMVALRRGATELCHEDFVEGVAQVQAKKKSSLNYFT

SEQ ID NO: 337 - protein, 683 aa, Neospora caninum
MALAHSARTRLAAVSAAQLALSLLLLSPLSLLFLSSVTAAQPPAYQAEYNAGYQAPPPPTSPPPPGETQGYTPPSGQANYGQAPQPPVQNYAAPDYAAQGMYGRPDGRTAGGTPPYSPPPQAGSSLPYAASYAPAAQAFSGDGVPFPPRKAFVEGAPHVAPPPVVPGGDSGASRRKETGRPLWQETVGSVELPRHSWAAPLDFESIQGDWDIAMATVPAERYLVLTPAVANRTGQFWHRQPLKTTNFEVQFGFGVYGDDKAYVDFAKANARRQTAQSPQDAAGSSAGPVLIGKPEGFAFWYVYDEYAKVFPKSPEEEKDWTLMGYKNRPRGLGVFFKMFDRYGQLRPSISVFYNEHGTRALDPLREIPLPAGVFYRYRNLPEPAVFKLAAGPAGVVGEIRTSSRGPWLTCFHLKDVRLNPGGFIGFTAYNGPEAASLLPTAGRDEKPGGGIADLVVLYFVKLWNLDLSVRGEDDAAVAQELSDVPVDDMLKFHSFHKDDKALADALKQLTRMMYKHIAEQTPREQAMQRTINSLLGQVTRLSTELRDMKKDILTHLQKATPGAGSKVGGSGDAKAGAGTEHALHTVRTELHGLKNLLAQHSQIHRDSLHTLQQKVEAARATGSAGAVAPELRELANRARELEATIAAKEHFSFFMTVGMILVLLAFAVFVWKRFRDMEKKHLL

SEQ ID NO: 338 - protein, 560 aa, Neospora caninum
MADGWDAEKIFNSTVFGFTYDDLILMPGHIGFGVNDVDLTTRVTRNLQIRTPIVSSPMDTVTEHRMAIGCALMGGMGVIHNNMETLRQVSEVQKVKRYENGFILDPFVLRPTDTVADVYRIKERYGYSSVPITDTGTLGGKLQGIVTSRDIDFLTDRHTPLSEVMTSDLIVGHEPIQLAEANEILRESKKGKLPIVNDRHELVALISRNDLKKNREFPLASKDANKQLLVGAAVSTKPQDFERAVALQKAGADVLVVDSSQGDSIYQIDLVKRLKAAFPDLQASLPLSACALLEAPCAFPAIFQIIGGNVVTARQAKSLIDAGVDGLRIGMGSGSICTTQALALGANAVMMGSMLAGTEEAPGEYYFHNGVRVKTYRGMGSLDAMRASARQACATASTSRAPRSPRSPQSSPSTAVSVEGASRVSALSGNDASPLSGGSEGDASGPAGGKPGLAHGDSGATSGNGAGAAARYFAENQTIRVAQGVSGCVVDKGSVMKLIPYVMQGVKHGMQDVGARSLSDMHAQLVSGDLRFDVRSGAAQREGDVHDLHSFEPREGIFAG

SEQ ID NO: 339 - protein, 553 aa, Neospora caninum
MKRISLASICFLVVTCLLLQCLPRDQCLAHYGSDSDGSNARPSGGADWATRTPAPAVGDYGELTGSVSRTQTKRVYGAGLWPRVRSLAVSRFPGAEEEQWEGAYARGDLPPSQAGDILTQRKGRTGRSRVHQRVVVTPEPHSWNHRVTIAKGQAVIPVGFEGSFVESRSLLATRSPPRALVDCQGQEEVQAAVTRCSVEVFASPEQHAAKEVLVSLFDDDRILKVKSAFNGAQYMLAGPAGFLGIGVDGIVLRLNQLEDGAARQRTQVAAKICFVFRRIIARLSWWGKRRLRKKIKRKCLMKESSVRRALPSVTPEEMLEHGLVVPTDVGRLSNLPTWFPADQGYFVLPVVSLYPVFSCDLEQLIHGDLSDSAKLYVTRRLVQSVAWMHEKGVSHNDLKLENVLLSADGQVAIGDFGLSSSLGSVSQVLGTPVYMDPETAESCLRQEEVDVVATRDAWALGILLFTLWCGVLPFGLGQIAHLHPRAVVRFIVTQATGTPPVPEFQLCGQIPAAVRELISGFLQWNHEDRRLPGDVVEAFLEATHNGGGERSRR

SEQ ID NO: 340 - protein, 341 aa, Neospora caninum
MSAPGTNTPSPTVQPTGHGVGSSPQGGVPAVAARHYVDSPVSSNNGPQTAPPSTFLLPPQHTAMSSPASPRKPDPEIIAVQSALTTTPPHSFAASVIDSSPCSPRSFRWYAGRTLDAPTSGSASFEVAQRSNVYSYAPISDRARYHVPWQSGLPTLDEEFRTVFRYEDLSNKERRDFLSLSGVAYPEQHTQRTQAQGSYLEHYPVPPPLDGHHFGGDPLLRSRLAPTDARSYMREQGHPGHPQKFYHNDLMLDNIMSPGKIGEICAGTVPTYVDVPNFGRMQGLFAKQADGTVYPLITLPKMTPHDIFKTIDKMQAQKRKSRRQHPFWTFVCCQRVEAEED

SEQ ID NO: 341 - protein, 986 aa, Neospora caninum
METGPQVVPRSLPRHQALFPGNPPKIRSSRLTVQIASCASPGERTATTSEPLLANAPETQRDTGACRRLSLCGATLPSRVLCFLPATRNLRSRSRALHSATKRASTQPIRPEISPPRQLFTSVGNSERTTPTKTRTSRMPSSTCFASPSLGPRKRAFVSRRCQRSKNCALSNTGPTTSSAKKQTPCKTHTCSGNCGRSNEKLTCPPSSPESHSPVDGPVSASQENLFLPERTQPHLASRRHLRPSAFSLSFCRFFPLFIFRLSFFVRLERVAAFVFNFASLSPHCSLALRPSIVKRRGSNAQLGEANSQPETKKLSPGKRETASTDVLCVNTIRCLGADLPTIANSGHPGAPMGMAPMAHALWGYVMRYSGKHPRWFNRDRFILSNGHACALLYSMLHLTARRLRRDNRGSAPVSPAEQQNAGTSRGALRGGHRNDDGNAVGIALAGQYMGAKYNKENFPIFDSHVFVFCGDGCLEEGVASEACSLAGHLGLHRLIVLYDENNITIDGEVNLAFSEKVQQRFKAYDWHVDVVADGNHDVAGLVRTMEAAKKRTDKPTLICVRTTIGFLSSKEGTAKVHGSPLSEDDLRKVKEKCGLNPDEKLQVPDAVKKFYEEVQERGERAVAEWNALFDKYKTAYPEEAKEIERMFSREVRPEVFETLKQLGDKAREKGDSTRAHSGRMLNGIKGFMPELIGGSADLTGSNCTDLQNEKSFQVANRSGRYIHFGVREHAMIAMANGMYHFGCMRPFCATFLNFVTYGWGATRLAALAKCGILLVATHDSIELGQDGPTHQPIEVLALCRATPELIAIRPADGTEVAGAYAVWLRDELKRVTLLSLCRSTVPVLEGSSFDGVALGAYILSDFENNGKKKVVIAGSGSEVHLCVEAKKLLTGNWDVRLVSMPCWTLFDEQPAEYRNKILCLSERKNGNVLTAYVEAASTFGWDKYFDVHVGMQSFGASAPGKALYDFFGFSPASIAKKIEEYKPPF

SEQ ID NO: 342 - protein, 1344 aa, Neospora caninum
MLRASGSEGSRVRAQLCRSRPRPSRTRRALSAASLLVLLGSGGVSLAAPALKPVETELPAPSPLAFLSATSPATLLASLAAPSPWGPDAPGLDGLETQSAQAAAVSPSEESNGWREGEVSSRPAAERRREVDQRTVEATEESANSVSTLSVPSPVGAANVGDAQASLLSFWRRRKAEETPLPSTASPITEAPAALQSALPFATWFGLGGKEGVHAERVDIQARLLFNEGTEAPRSEQALSSSTGESEAAPVRPDPHASSWFPSLFSGKTQTFAAMNALDGLTAFWFPSLRRGLGLDVQDADGVKDRSTDSSQETKEGETAADGTRVADNHWSHITGTANDPLPAARAAAWWFAQREEEVRGLAKAAAHQGSENLQHAADSATATAQAFWHQSGGAQASQEALAALEASAQWFRQQKNKLEELDAAGAAAWWEAVKKSQSDRLAAEETTGRAQAGAAAFLAHANASWMHPRQGEKLTAVGVDVPQAAGLAPAFLVPEGLAFWGTQTEENAAGALPSRGTKVGASQAAGPVTAQVPPAAAVAAAAAAAGWLNWSRTADAQKAAPPQEALSWFWSKQLKDVEDAVEMSSTWLGHSALGNMSRGVALSAAVGNGLLNVPLWGEGRKEVAETKEPETVASTSGVASVLSWWRGGEANDGENTPSLVQDEAPRAASRSDEPAQKSVEKSLMSWVRSWFSGGKEDPEAVSAAGLGEEDVKGGRSATSFARWFGQKQFPSPDTTAEGKKEASSASVPASRWFESSGAAGEKGEAKGHGAKAASAEKLSSSPPSSADGDVAFEQPVGLDKPSEPAGTAFGWPFQSSSAEPNYPSRGGQSQHIEDGVSRSAGSSWVPDTGFLRRAIEGASRPEGAQASLAARASQFLAQNADQASGWIFGGASESESHAEKPAAPVPGLKQGSSWWEWESSETVTTTKPPKYTRDVRLDCNPVPPFRACVQKCQSDSRRHTKDNADRSEPQALGSYEYGSLRSCYLTCKQKWIDTDLPGCLRADGVKVEGVPPIEAFRSTTTSTTTTPSTTTTTPHPKTSTQKREQPKPTEEAAKSFWDGLTGKTEGVADKAQQEEQKGLFSLFQRATPTSTTTTPAPPAQGFSLTKLLGFHPTASAPASAETPSSDSFPFSLRGPSSLWSAKNDAAAGLEPALGNGLFGSLFSRSDAALPSKAPLAAQTSMTDAGLQEADLSNASVSEKRKNESAGWWTWPASSAETGKEGAKASAVAAGVRGPDRAAEGAAYEAPESTNRLVEEADDAIENVLSSWWPVFLLVVGVGLLVLCFLGRRLGQWEGMAGSGDIERGEYAAAPVFRESATEQHDGRRSVNGPSTDENRQPLIDRSG

SEQ ID NO: 343 - protein, 1361 aa, Neospora caninum
MPAPNPAASPPVVPPLNAVLSTRPVSSPASPSGAPYFLAVTGAVASWLMLLCVAQELPYDLGEGLGIRFRRWLRAHPLLFAPWTAFLRWLGRRRRLGVASLPRLVETRKTPGEKSSSMPLRLSLLPVHERPAQLCLLLAVTLLSLLLSSFFVASPSDLLGSHLSLPRSSSSGTPPVAPGLSSSSPWLGLAASASPSPLQPPSFFLLPASASPLASTAAGLAGGVVAFGARGAETAEVAPKTSKGEKGSKKKRKTAPRLLQVVRPNERHTGKSFLLSQLLAFSYSHDLSYDPLPDASAANATSSSRRFTAFPVGYTVHPGTQGLSFWSEPLQVDRRTGKVVGGEGEDGRAKRKSTAGLGAEEVTNVLLLDTEGFGGPNVTRSYDQLLYAVASLVSSELLFTTMKMIDAQSLQLLEDLTRDANLFNLRAHAQSVNATRTLSASQTPGQDDSPSLPAVRATAGAAPEKERPGPVAGRAVEESVAGSALFSSLAPCCLSWIVQDFVQDLQGLTALQWLDRLIATHRWSASPAEVEKNFWKEKRGTEKGKKPGEEDGDNSLSHSLRSFYDSIQCVALPAPSSSSEALQRLDLLPLSEMTPVYRAAFQDFKDALLKRVANNFKAKSRLLHPASGGGAQGVCARRGGRSGETGEKSGESGELCGGEEMTGEEAREGRGDHENEQSEEETGKRNRRGSVGRVAMSGKDVADLLRFLVRAANLNMFENVQIFMNHFSTVRSDLAKNDLLLLFDEDMQRFLNVHPPPLPPLFFSFADSLRQQLLQQWQQQIRGQEGLHAHEVQQRQQEEMIQKLNEKVEKFRGIAEEQVRKYCREFCGKRLQQVQQEIQKHQQRLPMAPQALAEWAIYEQRLQRSLLTDEVNRGGRDFASADVCEEELRAYDEKVENLFLFLHKENTKKITASMQKAEEQAVAFFAEQLKQHPLEMLRPLEQFRALLFEWKTGAWEVFEQKVEDLRAVRQIYSVFEQRLTTELKRLEQQALQHWNEKCTEIASVGAGAGRRRDILHKWSNTYKAEVIASFPKIQSLPVDEDILHAASENKMQDALDEMNALYCAKTSPWQQVAGQLREVMRERQKELEMQNVEAIKTNCKEPLDKLLKKLQPEAESRYLWTTFLSLARREALAVLSSQNAQTRATVLLSERLVKRVTEHWLETDVRATYADTIWRNMVNLCQQIAGGIVGVGGLLIFSTYNIWMGLGMMAVGAWLLFGIVTLIGWMRGAFKFTVQGLWHGLQDRVGLEAAVGIFFITAAVVGATGFRWFSIRKARAVPYVAGPQTYQPSPCSMSRPCSVDPGAYSMAAGLSRASQSAMPQQMEFPTPLGVRSSAAPTSSMMYDSIFPDAERKSRYSTAYVG

SEQ ID NO: 344 - protein, 142 aa, Neospora caninum
MSDVESIADEVVAPVEEEEEVKDLMTAIRKVLKNALIHDGLVRGLHEVAKALDAKKAQVCFLSESCSEPAYKKLVQGLCKEHGIPLLDVTDSKELGEWAGLCKVDKDGTARKVVGASCVCVTDFGEESEALTFLQNHIKTLS

SEQ ID NO: 345 - protein, 154 aa, Neospora caninum
MSAVKTTIKTDICSFSEYRIYPGRGQRFVAKDGKVHTFIHRKEASLFRQKIKPVKLHWSLVWRRMNKKGGKDAVSKRRNRKSAKTVQKAIVGLSLEDIKRTRAQKPETKAKTTTAVKDAKEKKKSKAGGARPQTGPAQKVQIPKQQKQTMRGRK

SEQ ID NO: 346 - protein, 456 aa, Neospora caninum
MAFGRGKRGLHAAVILGFFVLLATSSVGLGQRVPRYPSVESLEERVAEALGRRSSAAASTLPGSDTNMISDGRAGRDEPTASPEHHSVDAPTTSGEGEADAGKVTLRNDEGLEGNISADHVLHPPPDSEHEGLQEPGTTHQEAQEPDASEAMDSSALPLSTSVPHPNEVGSTPGTALPAPIFSIPELSPEEVVYVLRVQGSGDFEISFQVGRVVRQLEAIKRAYREAHGKLEAEELESERGPTVSTRTKLVDFIKENQRRLRAAFQKVKIQQKLEEIEELLQLSHALKSLGARLRPCQKSNSPMEEEICRKTKALGEMVAQKAEDLRQHASTVSALLGREAVERQLRRVDSEQPYEQTDAGVAARAEEFRKALEKAASGARQFVGTTADEIVEEVKEDAQYLRDGAKEVLTKSQRALVDAFQAIQRALLEAKAKELVDAASKEAEDARKILAEQPA

SEQ ID NO: 347 - protein, 157 aa, Neospora caninum
MGKLVVPSDISLLEEKQTVGRRRLTVLERLGLMTMAPMVHWNYTKNDKHDMRQVLQRQYDLSRSDPATDIVVRRQESIRKRVVAHNGVWAGVAVSTLLGHYSLRRYDYKTKLIVLPFLAYGGSWLGRFIANGLTGRWSEWGRDRALGALPPKAFFEG

SEQ ID NO: 348 - protein, 398 aa, Neospora caninum
MVTSVAQPGGGDDERARALQEYVAKVKEHRECEAKVKKLREEVKKQSGRYEKTEEDLKALQGVGQLIGEVLKQLDSEKFIVKTSSGPRYMVGSKPKIDKASLTAGTRVALDMTTLTVMRKLQREVDPLVFNMLHEDPGSVQYGEVGGLSEQIRQMREVIELPLTNPELFKRVGIKTPKGVLLYGPPGTGKTLLARAMASNMNCNFMKVVASAIVDKYIGESARVIREMFAYARDHEPCIIFMDEIDAIGGRRFSQGTSADREIQRTLMELLNQLDGFDELGAVKIIMATNRPDVLDPALMRPGRLDRKIEIPLPNETARVDILKIHSSKIAKQGDIDYEAICKLCDGFNGADLRNVCTEAGMFAIRAERDYVVEEDFFKAARKLADNKKLESTIDYDF

SEQ ID NO: 349 - protein, 494 aa, Neospora caninum
MITDMNLSVVTPPELLNGDPGDRPDSKISPRCQSEAEGVADPEEIDAFVKQIETVNRYQPEFLQAFHEVFDSVKPVLCANPKYLRAFKVIVEPERCITFRVPWVDDQGKQHVSRGYRVQYSSAAGPYKGGLRFHPSVTLSVMKFLGFEQIFKNSLTGLSIGGAKGGSDFDPKGRSENEVMRFCQAFMTELSRYIGPNRDVPAGDIGVGAREIGYLFGQYKLLQAGQFEGALTGKDKNWGGSAMRPEATGYGCVYFVLELLKAQNRINIRTEGINGMRCVISGSGNVALYAGEKLALLGAKVMTFSDSSGYIVNEDGFSLGQIQRLKEMKEARSSMRVSEFAERYSPVKFIPGKRAWEVPCDIAFPCATQNEISEKDAQRLIDNGCRIVAEGANMPTTRDAIRLFKQHGVVLCPGKAANAGGVAVSGLEMSQNAMRIEWTREVVDEKLRQIMASIFSKCRSYAAKFGENEFDLVTGANIAGFVKVADCVIDQGYI

SEQ ID NO: 350 - protein, 351 aa, Neospora caninum
MSLSFHKTSPRQRKQCTRQIYGVAFPSFVAVLFFVVAESVQIFVEAKGERLGTLKPLGKNRYSCVQEDGTGPNPGVGSIELNAQNPKLFLLCVGQENEFMPLDGATSQLAVCPMSATTKAECDRNSTPLKNFLPRATERWMERTLVLDSSDSKFVLTIPPNGFPPARQQFKLGCRAKGHYCMLTVTVDPFSAAVDGQRANCAYSLPDPVSLQLSMSEEKNSITILCGKQHFPQPSTYNLNYCAGSSVDPDQCAASSMTEIFPTFSASWWKGKSNSEQGAVFTIPKGHFPSRATHFLVGCSEKVDAGSFCNVKVSVAAATVTTTRAPSNGAESWRTDFAFVLSAFALHLSTA

SEQ ID NO: 351 - protein, 592 aa, Neospora caninum
MRVGALFAALCAVEAGATVASDLHIETAYPPPVEALRSSLLRVPRVDASNGPRMSPLEESPQVEFGVGHPGGSNVPRRLGEKEEVGDGQSPLQNAQQLLRSPDTQDIGSAHARLGRLLDGQQRQQSERAFAAEPVATPDSDTDTEVDDKVEETVGGAPDEAERPRAERPVRNRGGDAPHHAQVPDRNAELSRFGEGFSNEHEGVSDRRLAELGAGAALEGGPQMDLGGNSGRGARLLRAPGWTNIIALAAGFLVSAFGYSAYTYGGPRVALRIHKLHLKRKMPLSWNRYLSNLPVLDESRFEEFDSIMQWLKPGVRLVKRVAHVSSALADFLGLDEETRRTGIVIKVKSSMGAEARRLMYEINAHTNMVPRNPFFLPLIGAFRGTSNRAVYLLLPRARADVADYVKARPFDVDVRLAAAEMVYAEYILHESGFLHRDIKAHNFFVGFDGHVLLADFEGVGVLQQRTPVVGTRGYFAPELSRPTDHTEKSDVFALGQTFKRIAKYLGQAVRIPRLNEFWSLVKKMTAKDPRDRPTMKAIMSDPYFDGIDFARLELKDQGVPFKGDFSIDVPDAAGPMFVQANVREREEDRRED

SEQ ID NO: 352 - protein, 420 aa, Neospora caninum
MDEVLRQSFVYGLCTTSLLSPTLYYYLPDRGRKWLRLFKKPVLTAMLLYLFYAAIPTDRRDLYTILDVDVMASKNDILQAYRTVSKKFHPDKVAAAEASGGAVPQRPSGFAKMTNEEFFMEIKKAQEVLMSDTRRSNYDRFGDYKYGETDEKTTIIVVCLSLVSHLLCFCVGFLVSYPRHVTFARQIYVVYNLAMFCNELQIRFVENGDSLAFLPYVSSLVPFERVHFFRSLFPCVLCASLCLAKWNFSDSPAKRLALLKALLSTNRVLTERTQELIRVTAYLKTMGTPSTAAIKTQQQQMNHLKSAALRARFAGQEMPVAPGAEETAEQAKETDKAGAQSANKLTGAQPKDKKDIAEWEDFTNTLNEEQKELFKRMVADQYRKTEAEEQARESNRRRFDINWGQVLMWVCILYVWIYYK

SEQ ID NO: 353 - protein, 547 aa, Neospora caninum
MYGLFRNSQTPCQQPLARLLCCFIFVVCFRNYASSAQEASPTAGAPSDESTKVENSSSDPHVDSVGAPSYIIATTSTSGLLSRTDLKSTTNDGFLDRFHVIRPVVRVPNMALVEDPTGVAEGNSLLQSIIFQFESASVRVEKVHEFAGRHLLTLAFPRAVSFARSSESPFTIFAESITSDSMDPSGWDKRSQAYLVCMTTRQFPTMWPEGATIRYPAVRQFPRFTTVYVRLEGLFVGCDVEEFRKGPWDKRVKVTDLIPLSTGQHDGANSYALLLTLSVTVPWLAERQSLASETQGDSNSGEVDFDMEIFEQEEDNLQVEKFLFEVDVDVRQPYHLAVVAGMLRETVCVLSREENTEKIHFNCPIFDRLEEKLKLFEEHRLNIRKRGNQFATAAWVSTAVAAVGIGSMIWGSRQPRKLRRALDNSLPQLLEYQFKLKQKSALSDIIRMARPSNMVGIWKVRQRNPRATAGGLAEGIGFWAFLSGLVGEAATFIGRMKTVDIEEQANNKRRANLWKRIESAAASAIEQFRRSTVSKLRVLFIVADDSA

SEQ ID NO: 354 - protein, 1236 aa, Neospora caninum
MGWVRPCKALGHSETVESLPAGPPVSRSFHRSVKKRRESDTAASLDLSKLFRVAASKSCGSCSRHSSGQSDGAQTKISWTSQNENPQSTPLSARKRAPFPSFVLLCSFLALFCALRSDDCIALQHFSAQALQVKRDPPELSRAALPVSSRWQPVKASGEDSSVPHDAPWENLSKVYFSSLRKGEDRSQARTVAAHRHSSDNRAVRDIRGGEESLRSSDELSDKRTLSVHHRSLRSLFPLASFSFPASALRPSKASVFSLGTDGVPASFSEVQSEQAEGEEKENTQSSSAAPNDSAEEGTQTEDASNEHASIQHGEPTVEHQPESAVSPPASPSPAEGTGDGPPAEPTFEILSPVGGTPGPASGEEQKEEQPHTGPRDGEQGQETAAGEVLSESLPPVSTTTTTTGTPSAFNVKEALLAPVPTGAVAAPLVGPVGNQQPETPGESGEGGAAAAGQEGAGEAQGTSQAQGGKAEAAPEQEQKEATEGEKSGEKKEEAAAGRQGENGPDATAETPSKADLDKAAAEFVKKEGGVGSLEKKLSEHGPKLTEEQTKTFVDTQEVAQNVRKLIGLKAGSNLHLENQKLIKAECDLATFGPEYCAARDNPNALSLLWSLEHRKNTIYFIIALITLAFGIAVQTCIRLLERKISEGKDEFSKEVMETAFRQIATISIVNVILWGTMQSNIAEVLDELVFGDVMPPLRDSDTVLENVSPMLEVLFEELFFVSVILLVWYVVFVILFQCMIRQIIEWMRKIDEEEDIPLIAREAESQNHRYEFADNVQAMSIPGVDPSGYYFMEYLRASLLKMAIEMIRLPNSTLFFLMIIDICLRPTFSFRLGQEAGLISGLSATCLLGMLLVWAYTSRIEKQLLPRHVPHYLVMRYHMEVGGDTGSEYLKEFAPPYKLQKQKNAWPGVCSTFLWGTTLPNKHQQLFCFWANGPNIVLRAVEASFFCQLLVLAWWVQLFRSHPATWLTFCWWGNVVVVACAAIQFALLKSVVYTVLLALNSGMLVDPELLEKVWDLQRAENVRRTAELIDALRVQSTLFAISEGGDMFWRQLLIRSKGASRQAQEQRLTLWAALDEEHQGEINRAKIFKFLTSQGLPIKSEAGVNDFLHVFDRNHKGGVNEDEFFVMVMVVKQMLMEPLDRDAVRELFEGRYGIPWTSPVGIDLANLSKILAELRLTLSEGKKRYLLDFIGGKRGTTAVSPDHFVSQLQAMEEQALNPIQNEGGRGPAVSGAERV

SEQ ID NO: 355 - protein, 646 aa, Neospora caninum
MAMCFSSTLGVLPSRKGVPFAFAPEFRPLPSSRSPLRSLARSTGPSFDVARRSVAGVAGVNSRNAGALGGPSACSPALSLPGVTPRNPLGSVGDRERSASGGFSPSRGEAKMRPFSTFSLKNLLPNRLKAAPTRPYTGPTQKVVVLGTGWASVNFFRHLDPNIYDVTVISPRNYFTFTPLLPSVCAGTLSPLSCIEPVRSLTYRKGRKVADFYEAHCTDVDFKNRIVACDSRQGGHFKLKYDYLVIAVGSETNTFGIKDVAANAFFLKEVEHAMAIRKKVMNNFELAALPQTPEKERDRLLHFVIVGGGPTGVESAAEFADFIKEDMSKYFPQLIPHVSISLIEGGSRLLGTYPPDISAFAEKTLRDELHVKLLLRSTVVGVDANSVRYVSTEAGASKEPKEMLHGFLLWASGVGEVPLVKKIVAQNYPQTDGKSRLRGLPVDPQFRLLNQPNVYALGDCAAIAPPRLADAAQELFSKAGAGEPTPQWLRHQIPVLSQQFPQLSPLKFNFDKLESNERLPADRFKSFLAEIDAAYRPPAPTAQNARQEGIYLAQVFNQFPHPEEKANAPAFQETWSGSLAYVGSGQAVAHLPYFTIKGGSLSLPFWKAVYTQMQITWRSRTICLFDWLKTFFAGRDVGRDHEYYNH

SEQ ID NO: 356 - protein, 130 aa, Neospora caninum
MASVKRFLVAVVVVNALSSVVVNLAGYVHGVDNGGEGGDVAGQGVGTQQLSPTPPPRANRSFGGYFQQGVNTMRRTQAVVSENPKKSAALIIAFLVSVSVVLRLLGRKKKVPSSQPLEKKAATEEAGEEE

SEQ ID NO: 357 - protein, 217 aa, Neospora caninum
MAAGGRPRDYDHLFKLVLIGDSGVGKSCLLLRFSDDAFTESYITTIGVDFRFRTINVDNEIVKLQIWDTAGQERFRTITSAYYRGADGIVLVYDVTDRDSFGHVDEWLAEVNRYANENTCKILVGNKCEKADDRQVSAEEGQRKAEELGISFIETSAKNAINVDEAFTVVARELIKMKQSASAAGGRSAGPQGMRIASQPTGAENRAMAQRSGNCSC

SEQ ID NO: 358 - protein, 242 aa, Neospora caninum
MVVPDFGNLKSDIGVGKLNEYLASRSFITGYTATQDDAIIFSKLLGAPNATKFVDASRWYRHVSHFSPVQKAAWPKGELTAEKPKKEEDDDDIDLFGEDDADKEAVKKLAESKKKEAAGKKKKEVINKSSLVIEVKPADADTSLDEIAKLCKEINIEGVTWGEAVKKVPVAFGLYKLQLCCTILDDIVNTNEIVDQIEALGMTPEQLEKLAKRQEGDDEDEEEDEETYGLVQSAEIVSFNKL

SEQ ID NO: 359 - protein, 331 aa, Neospora caninum
MSIDLRHEPRDSISSLCYAPNHGKSILAATAWDKTLRIYDVDANEQLQKFEFDMPLLDACFLDSAKVVVGGLDKHVSLVDLQSEKVVSLGCHAGAVKHCRFHAPAHLVYTAGWDGAVKAWDPRMHQTTPVGEGRLHGKAFAMDNGDAYLVVADSKKRTYIYDLRQGPQGLASPDYRDQILKYQIRCLRCFPNGTGFAAASIEGRVAWEYFDMNPEVQSKKYAFKCHRLKEGAGEVACPVNALSFHPQYGTFATGGSDGGVSVWDGQSKKRLWRLPAFPTSVAALSFNPSGNQLAIGISYLYEKGPVPTAPAPQIVVRLVKDEDVRPKALQA

SEQ ID NO: 360 - protein, 216 aa, Neospora caninum
MAAAAAQAVPEFKLILVGDGGVGKTTLVKRHLTGEFEKKYIPTLGVEVHPLKFQTNFGMITFNVWDTAGQEKFGGLRDGYYIKGQCAIMMFDVTARITYKNIPNWYRDITRVCENIPIVLVGNKVDVKDRQVKARQIQFHRKRNLQYYDISARSNYNFEKPFLWLARRLTNQPALSFVGEHAKAPEIQIDPNLVQEAERELQAAVSTAIDDDDEDL

SEQ ID NO: 361 - protein, 554 aa, Neospora caninum
MAKDAATAPASRGENAPSSEKKSPAPSPLLSLCLALEQLRQGVEQQDDRPITRMFRQFKTLRTACSPQILLLVSSRLLWDADLSSPASPDADKAAPGSPPKSSDAPPARQDEATLAFWKAMKDALEASVSEERSQAMDVDETPAAPFPLAAREFAFCSSEVETLLALLLLVRLIDSRRYAPAVDFGDRLVDRLLGSTGVDEPPSASPDLPRRRKRLDFIGAKCIFYWYRARELSQSLNQTVRAKLLSAYTVASVQHDTMSQATVLNLLLRNYISCNQYELALKLNSKACFPENLRSNAQQARHLYYLGSIQAVRLEYSAAFAKLQMALRKAPQQPRVAAGFRLAVLKKAIVVELLMGDIPERAIFSRKETRAALLPYKHIVLAVRSGDLHAFARVMSDFEKAFIKDGTLFLIRRLHHNVIRAGLRLISLSYSRISLEDVAQKLGLDSATSAENIVAKAILDGVIEATIDHEKKYVESKASVAIYSSTEPQKAFNKRITFCLQLHTDAVKAMQYPEAEETQGRGNDDADERRKALQEEMARVEDEELDDDDSDML

SEQ ID NO: 362 - protein, 450 aa, Neospora caninum
MEGQPLNDASREFDIVVYGATGFTGRLVAEYFCKQYLTDSGEFLVKFALAGRSMKKLEEACEAACARAGRESKHIPLIVADSSDEASLAAMCKRTKVIITTVGPYLKYGEPLVKACVEVRTHYCDLVGEAPFIVATSQKYGHLAAERGVKIVHCCGFDSVPSDLSCLLLEETALRTAKAPCESVTTAVTEMRGGFSGGTVASLLNLSGSEDTYSPYYLCNRALPENVSFTPPSKPYFPVRFLTHDKDFGYGAFFIMAPLNEQVVRVVFDAQIVEAVYSLCFIRWSSALMGSRYGKDFAYREMMSVNRGGFFSALCTSLLVYTGLLCMSFRPLRWLLFALKILPQPGEGPSQRLLDSGFFQMRAVGRTRCVEQPGRALRVSVTIGSKLGDPGYRETAKMIAETALCMALNMDKCTKFCGVGSPAACVGTVLKERLEAKGFYFEIDTKEEEV

SEQ ID NO: 363 - protein, 846 aa, Neospora caninum
MALHYAYPVGLAAPGESAIWRCPKYEEATAPKPAEKGPFLTTLDVEASDCSKGEFPEGESPPESGWWCSAYGVFRVGKSRAGGSARCMGARLSPADKEFFYWTFDEADEKARLLGSGLSQLLKDGVITVQTFPDEERNGGKFANVGILLHSRREWILTDLATSAYPPLSSVTLHYTFPPEHLKAILSEAGECKNAKGDENIAEEGVWTHDEKNRTEIRGESAQPGETRFFHTVSTLVTDVEQLKVVSELKADLPALKGLVLVNLAEETSRLEKENPDEKANLLKLVEEVRAKGVQVFDFEDILEKGRKAYISPIMEQDPERIFTIVYTSVSQWSVVTFSSSGTTGNPKGVMLSNRNFVREIQGCLCINHYTLMMDDDFLHFALLPLSHVFERMVEYVAYGFGAAVAYFSRKKELLADDWRYAQPSCLIMVPRVATLVLDSIESQMQQLPMLKRAVLNFAINRKLHARRSVSQSTVLGTLRLGSSGSEASMREERSMASAAKSTAESCTTRASTASAAPPLQAFWYDRVLGASSTLQTRLFGRAGRIRFLLSGGGKLNPDVQEKLEAYLATSFLQGWGMTETSGAGCWQAREGDGSLDNAGGPSAVMEMKLRSWEHYDAERAECPQGELLVRGENVFEGYFRQKAMTDEAFVFDADDAGKPGAWSRRWLATGDIAEIQPNGSMKIIDRKKSLIKLAQGEYLQTEKLESIYARSAFVDNIFVHGYDSQSYPVAVVVPNRQAVMLWAEKRRSGASKPNAKPLQKVSDEALAEVLRDPELKKDILLDFNRLATDASLLGFEKVKNVHLTLDVWTPDNGMLTPTFKTKRAVMCRSYRADMDRLYEELSHGA

SEQ ID NO: 364 - protein, 729 aa, Neospora caninum
MGTATRSKETTRRGSMHKQLVCTASHSSATNSNVVLPLGHHLVMATKTTSNALNQEMRSPVDTLNPDRFSWWKCLAHPDEAADGLVTEGYARLQILLAYLLPEVTDVAEPVELHQLTTPREEGQKGEAASLSRAERRDFTVSNLMPSRGYVRVSLNGVPVYRSAVLDISPDAINETAAVVKGEKEEARLPNTIFNERIEIQIHQPYSVVRVELFNRDVTLGVIADDDLLGVFEMPVQLMIPFKVYDLEVEFPPQFLREENEDWISCQGLDSPFILGEKRLVSPDATAQLLQTKQIFDAEAAAAQASGLDGPEGSDGAETGDPAPRTLDAPVKREAREAAQESAEKVDAGNVDLLTCTVNVAAAAAASAPQVSGLRSSSFTIESRSTVIDDWEEKPRPPLLPEGYSCGPRLRCLFNLQVVGRTPKGRVGSEKKQGSWFSEMCALALPIIDSADEASLPPLNFRKFWHDAKRLKHLAWDCVLSGLAESVAAIPTWENPFVSACCLASVMVATTQPQTSFALIFLLMGVLCLMLSLTPLSNTREAAIAAASVLTDAKRKPPEAALDSDAQAEKAEPGKGAESQLSGQKPSSLQAFESQQQSDEATMEDSLLKSLLSSAVPQSFHVQLRRAHKRLLKVTAAILYAHEKLRQRREVVVGLLWLLSLLSFYRPDITGMALRFGCGGTAVLLLVHRMPVLSPCLRLAVVFLAYLRLWHQRRTRQHLVAAPVVPRAA

SEQ ID NO: 365 - protein, 817 aa, Neospora caninum
MRQQYTPDQSRNGCKAPVFRGAAFGRHPFPCPKHLKETNPDLPLGIQPQCNCGQLRRSAVSERLGFVSARRRSRSRGSVPGYASEEAGRDARPVPMENLSAGEKPRFTQKRRRVVSSYWSSFRDPVTHLRKDSSECVRRVERLALQVGSAVMSLPDAVPKLHFEEETFEKDMRFLAFYSRNREEWVICEQACNAYGITIVPLYDTLGPESTAYILTQTRLRSVVASEECASRLLESMEAAKTRAAEQTENDKATHTTAEDGEKKEEGKENKEGQEKDGQEKDGQEKEGKEGDKEPKAAEGGEREKAGGAQTVDAIFVKYLFLMDDPGAPAKDLLERAEKLGVQVFTWNQLLEMGKENPMPLTDDVVATLSTVSTVCYTSGTTSSPKGVLMSHGNFVATVAGAVRGPLTVPQMTLHAGDTYLSYLPLAHVYERSLQNILFSLGGSVGFYAGNTLKLLEDIQELEPAVFSSVPRLFNRIHDRVFDSVRDKSAIAQSLFSQGLSTKIRKIKATGSPVHAMWDKLVFNKTKVLLGSKLRYMLVGSAPLDAYVHEKIEALFSVPLVEGYGMTETMAASFISLAGENTAGHIGGCCPCIEFCLSDISDEMPQHRIDDPEHPAGELCLRGPTVTPGYFRNRDETAKTFDADGWLHSGDVAVIVPGCNAVKIIDRKKNIFKLSQGEYVSPEKIENIYIQAPLVAQAFVTGSSTQSCLVAIIVPDAAKAEKWAAQRGLADRTLQTVCTLPEFHHAVAESMAAVAKEHQLKGFEVVKHFRLVSEPFSIENGLLTPTMKIKRYVASERFAKDINALYLRTGPGRTKEI

SEQ ID NO: 366 - protein, 225 aa, Neospora caninum
MAAKFLSFNQELNEAVDLKDWVKEEPVPDEPLPLRYVWHVWEQVQQDDRSKEYSDNTRDLAAFDTVQKFWQLWSFIPQPSELLDHKRMVRQDKNGRSHVVDAVMIFKEGIKPMWEDPRNATGGHFEYRLSYPQMSAGQIDEYWNNLVLGLIGSTVEGSDHITGVRLVDKLSQGRHSCIRIEIWYSKLPSRDVQDALLKEINKCMATKIDGSVGALPRADIKNHGK

SEQ ID NO: 367 - protein, 223 aa, Neospora caninum
MAMNAFRFAGDMLHLLSIVLLLLKLRRSKNCVGISCRMQEMYLLVFCSRYVDLLYHFISVYNTAMKLFFIASTAYTVYLIRFKSPISQTYDRRADSFPYEKYLIPPCVLLSLVTAEDWSISEILWAFSIWLECVAILPQLILLQQLREVENLTGNYVAALGAYRFLYILNWVYRYFAESPPYVNYVGWIAGVIQTALYVDFFYYYALSKWYGQKLVLPVHAEV

SEQ ID NO: 368 - protein, 460 aa, Neospora caninum
MKFVAVLFPVAVAVLLDTLFYASSGRKHLLDSLFRTVDDTEPAKEWLTLRKTLKLDDVKVLEYGGAVQVKLNTMHRFDLRSHPFCTVKQRIVKLLSDDDYVDIACLGSNCGGKCDLAAAKKKQKEGKNLSPNSCSRPLGLQFLDPEAAAAGTDKTLLVCDVFRGLLKVHVPPGQYRRDRHEPSHFDVLLSEADGKRPYFSNALLKHGDYVYFTDSSQSNNFGTKGRIILEPEPTGRLLEFNLKTKRATVVLERLAFPNGLAFTPSRDAILMVETKTRSIKKIHIAGPRKGQVKVWASDLPFVPDNITELPNGLGYIVGSAFVKKFPSSIQVSSPSVALSILKALHRRVANGLFFTHLQTVGEILYPLTEFEAFSVALDWLLTHLGGGGHLFHLDTQGTVRRWISLPRECSAVSEGFVASWGKFPSAGSVELSDVSHFLLAGSFAKNGICKIPLSALVDPK

SEQ ID NO: 369 - protein, 546 aa, Neospora caninum
MSHLLNAPIILLKDGVDTSQGRGQIVSNINACQVIADIVRSTLGPRGMDKLIHSENGVTISNDGATVVSLLNVVHPAASLLVDIAKAQDDEVGDGTTSVVLLAGEFLEAAKTFIEGGMAPQILINGYRTACQLAIEKIRELKVDLSSTPPDEKRSLLERCAQTTLNSKLVSGHKDFFAKMVVDAVSMLDESLDKEMIGVKKVTGGSYTDSFVVQGVAFAKTFSYAGFEQQPKKFENAKILLLNLELELKAEKENAEIRLKNPDEYQAIIDAEWDIIYEKLDLIAATGAQVVLSRLPIGDLATQYFADRDIFCAGRVDEGDMKRTARATGAKIQTAVSNVTPDVLGMCGVFEERQIGGERFNLFMHCSQTQSATIILRGGAPQFLDEADRSLNDAVMIVRRAMQTQTIVGGGGAIEMELSKYIRDVSQGISGKQQLVIRAFARALECIPRALATNAGFDATDILNKLRHKHAQGKGETQWFGVDCMNGGVCDAMKEFIWEPALVKENALAAATEATCIILSVDETIKQPSPNDKRGGPQMRMPPRRR

SEQ ID NO: 370 - protein, 503 aa, Neospora caninum
MKEATSDPGVLASAAAEGGKKKKKSDYAIEPSSSPPIDTSKWPLLLKNYDRLNVRTGHYTPLPHGCSPLCRPLQQYINYGAMNLDKPANPSSHEVVAWLKKILRVEKTGHSGTLDPKVTGCLLVCINRATRLVKSQQSAGKEYVCIIRFHAKPESRAKVARALETLTGALFQRPPVVAAVKRQLRIRTIYESRLLDFDDQRHMAVFWVKCEAGTYIRTLCVHLGLVLGCGAHMQELRRVRSGNLGENDHLVTMHDVLDAMHVYDSTRDETYLRRTIFPLELLLTGFPRIVVKDSCVNAICYGAKLMIPGVLRFESGIEVNQEVVLMTTKGEAIALAVAQMTSSVIATVDHGVVVTIKRVLMDRDTYDMRWGYGPRASEKKKMILAGLLDKKGKPNEKTPATWLKSEGYLPKLCGSEETNGEAENAVKEEEQPRIKEEPVDDEEERRRKKKEKKLKKKEREAEEEEGDRKRRLSHGSENGDATMDEAVHEKKKKKKKSSSAEDE

SEQ ID NO: 371 - protein, 766 aa, Neospora caninum
MMYATPVGSPGPGESAVWRSTGFAAYSGYSIPSIGNSLQSLFDPELQVSSFADTRVLDPPTENDWWWSPYGIFQVGMSLHEGPEKPCMGERKSSEVTDGFDYISYAKVDETVRAFGSGLAALLRSDGIKLETFPDEDRNDGTFANVGILLQSRKEWIFTDLAVSAYPPLTSVTLHYTFPAEHVQSIAEQSKLSCIVTDVDKLKLLEDLKPSLSELKTIVVLHARSPLDPPLDLDISEQKRQFATLGTQVLSFDEVLNLGREHPTRPVLKQDPERVFTIVYTSGTTGSPKGVMLTNKNWVAVIRSLYIQNPTTLGITSDFVHISYLPLSHVFERVIEYAALAHGVRIAFFSRKRELIPEDWRAAKPSLVLMVPKLATTLLEKIEARLNQQPLLNRLLVGFAVARKLRSTAKGSQPNLWYDDLLGASRIMRERIFGSPDSMKFVACGGGKLDAAVQQKLEKYLGLNIIQGWGMTETAGAGSWQAYRNDDSYDSVGGPTACLEVKVRSWESYDATKSEQPQGELLVRGDNVFAGYFRQKELTAECLHFDADGAKPWLATGDVVEIQPDGSMKIIDRKKSLIKLAQGEYLQTEKLEGIYGASAFVENMLVHGYDSQSYPVAVVVPDRRRVLDWARKAYGDAERAEDPAAAAPAGEAGDDALFQRALADFALKKEILAEFDRIASEAQLLGFEKIKNVHLTADAWTPDNGMLTPTFKTKRALLVRKYSKDIDELYRQMANRQFVSDVNTAVALRDAPWWRRLLPWLRSWWP

SEQ ID NO: 372 - protein, 160 aa, Neospora caninum
MSNPAYLYETPLETRVHTVKDVKADAFIALYANHLKKRGRFQLPKWIDYVKTAHAKELAPYDPDWLYIRAAAILRHLYIRPDCGVGGFRKVFSCRQRRGVRPNHTSKAGGKIIRYILQQFEEMGLVESDPEKPGRRLTKNGQRELDVIARQCAKPAVASD

SEQ ID NO: 373 - protein, 1044 aa, Neospora caninum
MVLHRKEARAGPGDLEKTKIDLLAYADYTLTRLADYGSEAQTSWADSKQGRSVIRLDEIAIQRHSSTAVSGVSLDMQVFLRALGFVYFVAFLVAFNQSQGLIGSDGILPAADYVRQMKDSFADAEAWERVKAFPSLFLLFPVTDFWLHAIPFVGMILSLLMALQGASNGFLLFFLWILYQTVNSVGQDWFSFSWESQLLELGFLAIWTSPFWSLSRLPPSWPTPKVCVWGNRWLLFRVILGSGLIKLRNDAAWKNLTALDYHFETQPLPNPLSWYFQNQTHGVHAAQVVVTHIVECVLSFLVLLPFRQCRLFGGVIQIAFQVAILVSGNLAFLNYMTVVSAIMCLDDHFLTCLFPSATLSRLPELVRGCRGTWSCPLVQAWPFRKSPLGASAGEAKDPQAKNGSDAESPLLGNRDAGREGTLPLSASTDDSLDGPRTCCCWYRPSFSRMVRSLRIPSRVRTQVQKEIKENWGKMLLELAASAAMLTCMAFVTNPVTSAVWMVIAVFFLSIIISSSSTFFTNTLVSNACAELVLLVVTLWSCIAIYQHGPAVWSVWLTACLFTVLIAFAYTTLTNAALIFRIHVEVLMFLLIAALSVPVVRNMVSPYQVMDSDLGNPFSLVNTHGAFGFVNKERYELIIQGTNASSPNQGTYWQNYEFKCKPGDLYRRPCWAAPYHYRLDWLMWQAAMGNGETVEEQHPWLGNFLAKLLKNSRSVTGLLAHNPFENTDPPTALRVLRMHYRFTRGPAFARGPWWEVVPQTKEVFIPPSRVPGAVAHLREQLVILRRREEQQRLEKRRKEEEERRRKEEEAFKRRIELAKEEEQRRKREAEEAEERRLAEQKRQAEEEKRVREQDEAARQAEEEALRRQEEEEKKLQAEEEKERQAEEEKERQAQREDEEKRRAEAEKNRKEQEEAAVLAKQRADEALKEAEEKARVNADLEEQKRKKEVLEEEKRQKEEKEAAEKRRKEENASREAARAAAEKEAAKAREMEEQAKKAAMAEQARVEALRERQHAQTGQKPAVVPSDGGVPLRHAPLLSRRKPTM

SEQ ID NO: 374 - protein, 132 aa, Neospora caninum
MGRVRTRTVKRAARQIVEKYYAKLTLDFQINKKISEEVAVIPSKRMRNRVAGFVTHLMKRIQKGPVRGISLKLQEEERERRMDFVPERSEVDVATISIDQDTSDMLRALDINLPNVVVPSAGRPSNNQNRRG

SEQ ID NO: 375 - protein, 339 aa, Neospora caninum
MFLGLFASPPLASSYPPLLRVAQAASAGSQMEGPKTADVRTFAIYRYNPETDKRPYMQKYELDVSTCGPMVLDALIAIKDRQDPTLVFRRSCREGICGSCAMNVDGKNCLACLTPIQRAERENEAMRLMPGQDIKHDRHEEEVVSRVTDKINHALFREANPPVEILPLPHMMVLRDLVPDMTNFYAQYRSVEPWLKRKTAKKDPNVENLQSIEDRKKLDGMYECILCACCSTSCPSYWWNPQAYLGPAVLMQAFRWIADSRDEFTEERLAAINDTMKLYRCHGIMNCTVSCPKGLNPAGAIKKMKDQVEARFSPDWKNLQAQQILQKSQKLAQDLGLSA

SEQ ID NO: 376 - protein, 487 aa, Neospora caninum
MSAAYYTRRPGPSGSPFPQSQNGGERNANQGDARGGGHGMGQQGAPAYGYAQPRMQHFSHQPQNSAAPSQPANPAHVADPNNTPDGDEGWKSQVVLPPKDNRVKTEDVTKTKGTDFEEYFLRRELLMGIFEKGFEKPSPIQEESIPIALAGKNILARAKNGTGKTAAFSIPLLEKCQTSKRYIQGLILVPTRELALQTSAVVKAIGKHMNVQCMVSTGGTSLRDDIMRLYNPVHVLCGTPGRILDLANKGVADLSNCHMVVMDEADKLLSAEFQPIVEELIKFVPRERQILMYSATFPVTVKDFKNKYLPDAHEINLMDELTLKGLTQYYAFVEERQKVHCLNTLFSKLQINQAIIFCNSVTRVELLAKKITELGYSCFYIHARMMQSHRNRVFHDFRNGACRCLVSSDLFTRGIDIQSVNVVINFDFPKNSETYLHRIGRSGRFGHLGLAINLITYDDRFNLYRIESELGTEIQPIPSQIDEAIYT

SEQ ID NO: 377 - protein, 490 aa, Neospora caninum
MPTPMFQKTARFWRYMTCLAVMSCAAAALGLQTGPNLHRRLGRFEPGMTGYVPQRRGTSVKHSPTEHSPTELSTTGRSTATPLVSPHEGLLHPYTTLAGQARFPFGNAARQHASNVHIRTRTLSGSELPEIGAFARIKQQVPELDDEELNQRTERWVENTAKMLEEPKGEDSGDERPFEDSEEVSELNTVLMRLRQRLSESKSARAKVDNCLEKLQLFPKEIDAGEVCQGERDEVFDHCVKQVERWVANGKLSSVFNYYEVPAVTGYLLFVPLPNPPSDFLFYARLLRRVANGPCREFKNEDEIANAVASLLYTVPAAVAELSAGYRQFHLPMADSITRLLTLELLARLFFRYAYWFVNNPRKLVLLNQACRSQSICRRLVRMILHTSPPMGDMKAPPAMVRWFASYLKLVVPNRGGRVMQALAPLVAETLASSLHHEFPAASQPSSEGDQKEPATPLPRQRQSVALRLRKLFNLWRRRRQRRERNQNLE

SEQ ID NO: 378 - protein, 161 aa, Neospora caninum
MSDAEDVTFETADAGASHTYPMQAGAIKKNGFVMLKGNPCKVVDYSTSKTGKHGHAKAHIVGLDIFTGKKYEDVCPTSHNMEVPNVKRSEFQLIDLSDDGFCTLLLENGETKDDLMLPKDSEGNLDDVAQQVKNLFTDGKSVLVTVLQACGKEKIIASKEL

SEQ ID NO: 379 - protein, 120 aa, Neospora caninum
MKGTTRKAQNKSLQPVCRDYTIHLHKLIHGIQFKKRAPRALREIRRFAQKTMHTKDVRIDTKLNKFIWSGGIRNVPRRVRVRIARRRNDDEDSKEKFYTLVQHVPVASFNNLKTEYVNEE

SEQ ID NO: 380 - protein, 239 aa, Neospora caninum
MVDTRDGGHSGAASILGAEAFPELLNKVPLNPQMDEDKHFNKYRWGNEPIPVSRRTGSRMYSSIYDNRNHEAVRHPWSTDARTFHANEHPEADRINTQYSNMVSDNFPEGGFSDAPRFASNWERLLAYHHGLYSPEMYNSTTKTADEIRLAVNDFAAKVHADDPKNACKYLMIEEFKCLQSAQAHIDPQGAATKCVKWFNEWRQCAWDQEKMVKGYNYIEDRRARKHKPYIGAPDLQYS

SEQ ID NO: 381 - protein, 131 aa, Neospora caninum
MTLPQPMQTPLSGCLSRSESRFGAASCRLTAAFLVAVFLGIFAGFSPTHPGSGKVASFFPQTLGASAAYFYVQESQDKCFVESVPLGVALTVTYNNPENPGVTCSIVYKDPSGRSVYSKEVLPTEPQGKIS

SEQ ID NO: 382 - protein, 377 aa, Neospora caninum
MNVDPGVLRKLGGLGAAALATAAGGIGLFNYSLYNVEPGHRAIIYNRFYGVLDRVYSEGTHFCIPFVERPVIYDVRSKPRTLVSLSGSRDLQMVNITCRVLSRPDVPMLPTTYRLLGKEYDEKVLPSIINEVLKSVVAQFNASQLITQREVVSRAVRDQLVDRAKDFNILLDDVSLTHLSFGPEYEKAVEAKQVAQQQAERGKYIVLRALEEKKSTIIKAQGEAEAAKLVGSSLRSRRREASELCTHSTALSTQARAAWRRQPSERRRDRGGERNGTDREREREQEEGRKTERERIGNAIKNNPAFLELRRIDTAKEVANTISKSSNRVMLNSDSLLLNLMGSEKRCRAHCVERRALSLLGHSWCDLRGFHSFASSG

SEQ ID NO: 383 - protein, 306 aa, Neospora caninum
MKINVRVVDLQDDSQHTVIVESWETVKTVKTLIEEKTGIPGPEQHYYLGDQLIENSMPTEQLRKRAQLEGRLPPDDGDGVNLVEVKMYAGKEPINFHDLFFQDVIKKLQTHERIMKHITVRLRKKDDDTKYYFYVDIAFLTAETLKADLIKRLGPSSLTGLTADNILMYIRQEQPGRPLEGLQIRDCIGTRRAIEIEVYPMNPEVHVVCKVKKWGLCTQEQFTIRIQDHLLLNDLKEILVTRLRNLTNPKILHRDYTVGGLKFKLNGISINPTSEASLKRKYGIPAGELWLRAFNLNEGSLVVISL

SEQ ID NO: 384 - protein, 487 aa, Neospora caninum
MATEEMREKSLKREAESLWDIPPEAYASRACSCMGTAAQLVMVAVLGSFQFGFNLSALNTSKAFIILDFGWCKDESGGHYSDCDAGLVYGSLINTAVFLGACAGCLLGGRLTDFGRRASLIFTHCVCTLGCILSAAAEGFPTLLIARLVVGVAVGLFTVCVPMYCSEVTPDDRRGFFGTFHQLFITLGIFVGTVLGLAFGNAPAGGEVYKVSTFQQAWWRVMLGVPALVSLVAIWLLWFVFPFETPQYMVEKKQKAKAAALLREIYGRDNVDVEMQRIVTGRYQQKIQRAQQLTVWKAILHPTYRSVILLACLLSIMQQFTGINVLVANSNNLYSSLKLPQAAITGLTVGFTALNVVLTVITIPLVDRLGRRQLLLFSQALMFVAMCIAFVANLVDQNNTAVQWVTVACVYIFIVGFAVGYGPVLWIYLHEIFPPEIKQGAAGLASALNWVATVAIVLPSDFLLKQGFSVFVGICTVALAIIFVVTF

SEQ ID NO: 385 - protein, 552 aa, Neospora caninum
MSPCTFLLVFLLFSCIRGLGRANSAQRSIEHHNGVTKRRLPQSVGIEKNIGVQYKNVSFSARATGPFAVQQSQTGPNFVQLTSTSQVPRRRRRQQERNVNSEEPPMRSGNRRWGWLSPRAWLRGAASRLGRGTNSRRCNESPEIVLPPGIAVIASLLQQLREEIERFSVQQRNKPQLERAVKAEFFRLGTTKTLVSKACGLPRTIKFEAIISSGTWSTVWRVTDIREKKQYALKIRRLRGALSGKAGYTSILKEGQSMIEVSPAYTFESLKLMVALDILRLEGVPHFVKETDSRHTIANLFLLMPLAKTDLLSFLQALFSRPPISESPSGFQARLKITAESVTIVANFQRPGVVHGDIQPQKMLIMPNGSVVLGGPLDIHYPGTRRSPDVFTVPYLPPELLDEEGVYSYLTDSWQLGLTLYQIWCLRLPFGLMTPVVADDPDYYIVEEVLRKPDAELSFEQAGCVANIPEYVESLIKQLLQFNPENRLTPARILVSRDFNRLRAHVDHLERSARKPVDIPPPRAPRLVGWGPPGLQDGTELQGNNTSLESQN

SEQ ID NO: 386 - protein, 462 aa, Neospora caninum
MAQTAPTQSGPTPGFPPLASMTSFPAAGTAPQTQMPGAPPSPLFTPPAGFPGSMPANQTVPGMATMGSFAGASNPLPMYNWHQNRIPMDNGGVFGNCCGGAQMGAVNGAETYEQGYGDNMWRWTRDGKLQLRCGQPLVPVPVIQEIHRRDKIIEVPQVDVVDAVRPKVYNQGVEHEVPVMQINADHEDFDVEQIKYVEKEVVVPIVTGFTHKFVAKWDIREVPRPVVKYVGKQEEIEVEVPQVKFVDKVVEHEVVVDTIEKKVPKIIEVPKYVDEVKYVWTPVEKIVHVERFVPVFDVSLECPAPLIVPYPMQAVKEMPAVMVRKEVPDSAIAEQGFDVASPPGTLRVSDEYIRAHNQLAAEDAMNLCGAGAVCGPPQQGRQMEFLTADQMKEVRAAVQEGRTSEASRQLNRGSSVAQMGAESEPRQGSGDERLSERTERSARSGEQQRSRGSSLISEDDVH

SEQ ID NO: 387 - protein, 651 aa, Neospora caninum
MDTAAPSAGRRARAFCLLLSCCLVALPLSSANALVPPSSETVGPSFLAASSQSPAEPPQERLAGNRRDASHSSSLPSGTGSALRIEEIASSGSSPEVRDEAPRAPATRTTEKFIRPYHTGPSHRSSAYSATSGIPLCHTCSTFDAAKGGCRLCLHGEVASDFMMPMTPIRNIDTHREETLARLEANHRTHLNDNKNFYVLRGKGPFGSLGNLPGTPGLDAAVAFGVVPPELPSASFAQTHSGQNSNPGDVQVGASAGGADVSNEATTSDLDLKLAETSVPILQMKDSQYVGVIGIGTPPQFVKPIFDTGSTNLWVVGSKCKDDTCTKVTQFDPSASSTFRTASPPVHLDITFGTGRIEGSTGIDDFTVGPFLVKGQSFGLVESEGGHNMHGNIFKSINFEGIVGLAFPEMSSTGDVPIYDNIIHQGTLKENEFAFYMAKGSQVSALFFGGVDPRFYEPPIHMFPVTREHYWETPLDAIYIGDKKFCCDEGTNNYVILDSGTSFNTMPSGELGKLLEMIPPQECDLEDPEFTKDFPTITYVIGGVKFPLTPEQYLVRSKGNECKPAYMQIDVPSQFGHAYILGSVAFMRHYYTVFRRSDGTRPSLVGIARAVHSDDNRAYLSNVLNEYPGMHMRKQDLMMERSMNAPSMREL

SEQ ID NO: 388 - protein, 1067 aa, Neospora caninum
MHCLSGAVTGDGDVTGANLRDLVNVDSSKERAVQFSAAGDKGPAESGLRHTPFHVAQSSVPIRHHAFHSADEATEFPEAHDEVPTKVEERQGFGEGGDSAQQALTADGRRSLLERKSVCVMSCCQASSSTTTEDDFDSLFKDDVPKKPKKGLDKGASSGETGSGKGNSGADSLSSLLSGTLNTGSNNKREQKSDARSKSNISSLTKAEKNRPMSKLKSMGTSSADFDFDLESSSNTRARDKGRSSPDSSIEDAFGSDSGGIFGSSNDFSNFGDSATSNGNLLASLGDAPDAHSDKPSRSPLDSTLTSMVNPFAQQPSMTPMTDQAEKWSKENLREFEHRMPNKMRDGPNPDSWYKNNISEKSVADLNRAREIRRTAEANQIATPIETVYTRAIKTVPAINYLGAGYDHVRGNPIGDPSSMGDPGLRPPVLRFSYAQNEDGVSNDLTVLQPIGGYVRPYVACKQSETVSELSTLNDYQNELSVDASLQGGDPIGLNSFSASAGYREFAKEVSKKDTKTYMLRTYCMRYEAGIAQGDQFKWNVTLAFAAAVEHLPDTFEGHNPHCGCSPEQWRQDEAADVCAGSNIPTWIRFIEQFGTHYLVRLFAGGKMTYQVTVKRSEVEKMKKKGADVKSQLKMQLVGVSGGGNQGVATTKNKSSSNYEMNVQKETLVIGGRPPANVSDPGALAVWADTVEELPMPVKFEVQPLHFLLPLEKQEAFKQAVAFYSKAVGLTSQDLSALTGVTRNLPTELTKATQVAWSGPPPGFAKCPEGQVVILGFAMHLNFKERGTDNFRISMCPPGREKCDGVGTASDVTDDGRIYILCGDEPINEIQQVVAETPIASGASVLEATCPDETVILGGFGISVQDGADGIDSFSVESCTTGGRQFKGDEVVDKIVFELINVATLGSHGKTNKHAPDQDGSVRVECPENTSIVLGYAMEMHTNMQLVRDKFIHCPEDGKACQLSGKGVDKGVLWVFDKHALFGWVICKTVNEPASHVATDVGKAKGTSKKKKGKKGKNEKHQHDGEEEQQPVADVPTEAPVTTDAAPLPEFNSTSTLQLADVKLSDL

SEQ ID NO: 389 - protein, 467 aa, Neospora caninum
MGKTKTAATPDAHAPERRLFYGCFALLGATMAISHFVALPVLLQMIVYTVSIVYIGSHASLKQNEVDEVTGERSNKGEAMNHTDAMLFPVFGSLALCSLYIAYKFLDASWVNFLLTLYLTAIGLVALGETLHVALVPLFPDWANDPSRISFKFCLPHIPFICPRPELSTPSAKEAFEASCTYRLSYSQLGAYILAAGLSALWLWKKHWAIHNLLGVAFCIQASRREKKKRRSRGRTEKGRGAGSIEDLKRASGVYLELRFFSRSWSVSGRTSPARAISLVSVGNFTVATILLSGLFIYDIFWVFGTDVMVTVAKSFEGPAKLIFPVNLDPWQHSILGLGDIVIPGVFISMCLRFDYWLATASLANASEKKTAVETSIDIHQKFSKFYFFVVLVFYEFGLLTTGVIMLVFQHPQPALLYIVPFCLFSLFGAAALNGQVKEVLAYREDEEEKPAEVEGEAEPTEEKKSK

SEQ ID NO: 390 - protein, 465 aa, Neospora caninum
MSTTEDRVAAASQQVSNAGSVAAKGPQALSRGDFLLASSFFLLVGVNSLIAWNITLNLNPYFSTHYFSGEEWGNTLLAMFQLACVFCQLYLLKFGTGGPNKLYFYYAAAVNVVTFVVFTPLVVYLPQTAAIACMHICCFFLGIGCGVLQGGGFPYAASLPYNFCGFISTGQGLAAILSFVWNTFFAFVCFDLDTPEGVEKMAWASYCFAACLSVLYFAMFLVILKKPWAQSPFERQVLEDVGAKGDKAMQAVDGKKGDREAQYEHQDDGTFAGTAHTSTVDVESGERVDGTEKRPARVFLLCAAPHFLNIGVTFFITLNNFPRIGPVGWNYNQQIANHFIILFGAYALGEFVGRFFPDLSQLCPKYFSWTMIPPKLVVPLALLRAVFYVPFFLGYKLHDTQVVNDFWFYFIIMLLFAFTHGWFCTLGFVYSMTSVRESERGVTAPLSVLSLSAGILAGLYLALAY

SEQ ID NO: 391 - protein, 656 aa, Neospora caninum
MATNGDVPALTADEQRREAKTLQKLQELGIDYQVHRHAPVATVDAMVKASFREKGLIAANLFLKEKQRFFLLTVTHDLPIPLKGIAKLLSAPRMRLADEELLGPMLDVSRGSVTPLAAMCDAKNEVTLVFDKDMKENPDLVVLVHPLHNKATVALKAADLLKFVEACGHSVTWIDIDEAVKLAAAPAGGAEKAKTPAKAPAAKETVNDSSMLGVTVKKDENFPEWYTQHKLEKEKDHVEGFSPEVAWVTHYGDSPLAEKIAIRPTSETIMYPAYSKWIRSHRDLPLKLNQWCSVVRWEFKQPTPFLRTREFLWQEGHTAHATEEEAWQLVLDILELYRRWYEECLAVPVIKGEKSENEKFAGGKKTTTVEAYIAENGRGIQAATSHLLGTNFAKMFEIEFEDEEGHKRLVHQTSWGCTTRSLGVMIMTHGDDKGIVLPPRVASVQVIIIPILFKDENTAEIVAKCRELKALLEKADIRVRIDDRPNYTPGWKYNHWEVKGVPLRLELGPKDLAKGSARVVRRDTNEAYQVQWDELVPKLQELMDGIQKNLFAKAKARLDQGIEKISTFDEVMPALNRKHLILAPWCEDPESEEQIKKETQKLSEIQALEAGDSEQVMTGAMKTLCIPFDQPPMPEGTKCFYTGKPAKRWALWGRSY

SEQ ID NO: 392 - protein, 106 aa, Neospora caninum
MPIEHITTEAQYKSLVEDNEIVLVDFYAVWCGPCRQIAPVVESMSAKPEYAKVKFAKVDVDELAEIAEREDVNAMPTFKLYKQGKAVDTVLGANVERIEEMLKQHL

SEQ ID NO: 393 - protein, 115 aa, Neospora caninum
MSRAEPDVQVPSGDIKAGAKVFKAKCSQCHTINAGGAAKAGPNLHGFIGRESGKADFPYSDANKTSGIVWSEKHLWEYLLNPKTYIPGTKMVFAGIKKEKERADLIAYLVDASSK

SEQ ID NO: 394 - protein, 155 aa, Neospora caninum
MDGAGKVGGKVGGKVGGKVGGMGKGGKGKSGSGKGKKAPLSRAARAGLQFPVGRVHRMLKSRISSEGRVGSTAAVYASAILEYLTAEVLELAGNASKDLKVKRITPRHLQLAIRGDEELDTLIKATIAGGGVIPHIHKSLMTKGPSTQPMKKAKK

SEQ ID NO: 395 - protein, 82 aa, Neospora caninum
MQNDEGRIVDLYIPRKCSATGRLIPAKEHGAVQINVGQVDEHGRYTGEYHAMAISGAVRQRGESDACLNRLMHEKGLLSFAK

SEQ ID NO: 396 - protein, 151 aa, Neospora caninum
MTVPGMKFSLIPKANRKAIYEYLFKEGVIVVQKNGKIERHPEVPVPNLHVMMTLRSLQTKKFVEEKFNWQHNYYFLTNEGIEYLRTYLHLPPTVFPSTLTKKGTGRPSRGAEAMGEGADMNGDWRPRGGFGRGRGRMGDRPDRAERAPRYA

SEQ ID NO: 397 - protein, 196 aa, Neospora caninum
MLASADEAFLDHVKKGAGEHVGGTPVDLVMKDVYPVIVQQGLGGLFNRIVYKIKGLLYFRQADAVSDVIMAELEHYLFGAKGANQASFKVLRREYEKYMREFFTETPEEPMDAITSGVWKTLLRLFTEHLQESLRGSPKSQLMADLLFDENLALIKQWTDNDHLQIMQLSSHDARMEGLERLREQKKKKSVLARKN

SEQ ID NO: 398 - protein, 283 aa, Neospora caninum
MATEFAVPPSMLAVPNAGNGAQNVNILPPGAGTRVVDVPFVHYRQTMCVKEVKVPVEVTKVAVKKVEVEGIHEVPIIQPREIGVHQVVRRNVPEPIDVYTVQKYTMPRIQPKYYDVEVPIYVPRYVEVPVPSHFVTLQKEDIPAVVPVGPPLQGVNSAPILKNEQAYSLAPAADASDEAAGPVAPGVVDDNFSFHRQGSGSSDLGYSKTAHNETLTAEVIVQGSAASYQEEASGVAVVGNDAAGSLASSPRVFSRVNAAAAASGEMESDNASERAESVDSMPQ

SEQ ID NO: 399 - protein, 172 aa, Neospora caninum
MPNPRVFFDISIDKKPAGRIEFELFADAVPKTAENFRALCTGEKGTGRSGKPLYYQGCPFHRIIPQFMCQGGDFTRMNGTGGESIYGEKFADENFSYKHSEPFLLSMANAGPNTNGSQFFITTVPCPWLDGKHVVFGKVVAGQEVVKMMEAEGRSNGQPKCAVEISACGQLS

SEQ ID NO: 400 - protein, 206 aa, Neospora caninum
MPRGPIDDQEGRKVYIASAVCVPVLGCVIYGLASGGIEADTTTEELESLFGKYGTISTVWVARNPPGFAFLTFDDYRDAKDAVAELDGYRYRGKPIRVEIARGPGDKRPRRRFVDDDRRDGRGREDWGWRGRDEERRGRDDYDRRRRDDDDRGEREGKYRNSEGDYRSRDEEYSRRRDRSRSRSDDRSRRYEDDDDSRRERRRDYY

SEQ ID NO: 401 - protein, 161 aa, Neospora caninum
MGNTCKSCCGEAADSQLEIETPENGSKAASPPEDLPKRYSPEFLERLHKGLTIGLILQDKSRLDCMVKLTEGNSAIELSCERKSRVVKLSGIRNILYTAEQLRRVDCSAGISKNDFCVALHLVTSGNCIPLFFSNPEDRDCFVLVLQELRNSSAPPSGPPS

SEQ ID NO: 402 - protein, 274 aa, Neospora caninum
MGNQCCAGRDNAYKRKAQENEYANRGSFRHMLSFGAVGDDVVRFDRAYDNNDIAEFVRLCSSTCEIEKLEERMHPWAADPETIGALAATQLAIFSSREQEPHMKDEIREAGGIEALVKLLASKELDRKHAAVVALSFLSVDNVENCIAMYNAGALPYLIQGMKGDIEGMRAACAQTARNIYVLDVKYRREFMKNGGVTQLVRFLDINPEATNVYTQLEAIYHLEDLIGDENDEIPEFVQAVKAAGAIPKLKKLQDCKDQDVADAANLLLVRLSE

SEQ ID NO: 403 - protein, 289 aa, Neospora caninum
MATSVSLFRLFSSTKAPLSLPSVLASAARERAFLSSSFSSAALREGRLAAAPTCFQAPAGLAPQSRFCGRTAGSQVSGFSVQSADSRRAFSSEAGEKSVEAASKDLLKTIQSEIQHEQSTYEQDAELTKFIQSSGWSVGESDNNMMVTLQRQVGSKKVVVEFSCVQSAEAPTEEGPMPEMSDFTVTITNPDESGVTFYCSTTQDEEDKFRYCIGQVRFFKNAEEKESLNVYPGPYFEDLDDSFQQGLDEWLSKMGVDPELCDFIDRFSVDKENREYLAWLKKLAQFVEH

SEQ ID NO: 404 - protein, 238 aa, Neospora caninum
MFCTKDDAEAQRQIQQMVKFILNEARDKAQEIEARSLEDFNIEKLKLVQQMKDKIRQEYEKKAKKLETQRAIDRSTAVNKARLRRISAQDQVLSEVYTQALSQLSAVSGNQAKYQKLLEDLIVQGLLRLLESEVVIRCREMDKALVEAVIPNAVKRYSEIMRSEAGLNKTVTATLDKSGRYLPPPPSDDNPGMSCCGGVVLMTRDGRITCDNTFDARLRMVIVECAPTIRNTLFPSRQ

SEQ ID NO: 405 - protein, 214 aa, Neospora caninum
MSPYQYLFKYIIIGDTGVGKSCLLLQFTDKRFRTDHDLTIGVEFGARLISIAGRQVKLQIWDTAGQESFRSITRSYYRGAAGALLVYDITRRDTFIHLTRWLDEVRQNSNPHMTIMLIGNKCDLERREVSFDEGAAFARQHGLIFLETSAKTAQNVDEAFILTARKIYENIQRGIYDLSNEAHGIKCGPINSYGSRQGSEQPRSLAEQRSASCC

SEQ ID NO: 406 - protein, 306 aa, Neospora caninum
MASLDVDVDAVISKLLEVRGSRPGKPVQLTEAEIRGLCHKSREIFISQPILLELEAPIKICGDIHGQYYDLLRLFEYGGFPPEANYLFLGDYVDRGKQSLETICLLLAYKIKYPENFFLLRGNHECASINRIYGFYDECKRRYNIKLWKTFTDCFNCLPVAAIIDEKIFCMHGGLSPELNSMDQIRRIVRPTDVPDTGLLCDLLWSDPEKEISGWGENDRGVSFTFGQDVVHNFLRKHDLDLICRAHQVVEDGYEFFAKRQLVTLFSAPNYCGEFDNAGAMMSVDETLMCSFQILKPVEKKKGMTK

SEQ ID NO: 407 - protein, 386 aa, Neospora caninum
MSTLQDIRLPTWQDIRRFVQDPEIVTAEILFLILTLSNVFVMYRLFLDVVPYPVFVTWWQLAQGLFMAWCLGETGKEFPKFAYFPRVELDKKLLKKLVVPAVVNALMLVLANVVLYRTNCIATLPVTVSFAVVLHHVTRFIGCGEEYMPLRWQAVGMLMLAFILGCTDAKTVGAQVLPWAVLYSIFSAAFRAAYLQKVMHEVDGRGNLLYNHQHVIGVILLPVLCLLCGEYKILTSMPMNFTLLHTWQVWGCLVTVGALPFLKNIVSNRLIRRTGQGPWRFLEIVSIALVFLIGLGFGVPGWQGFICIILVLAGRTFCAYDVIMNAAEVEAARETRGGGGPAPHELGDANELETGSQSSQKPFLQAIEEDGGENYSDIRDDEVTTS

SEQ ID NO: 408 - protein, 129 aa, Neospora caninum
MVSAELLWQCVRRNHCFIRKFNGITLSAERMNLANKNTLKYSGIAHKQPLGLNRHGANGGGIALVTVQKCSRAMRKPTKAVQVRKFKKSKKEISKVMKAVAERRPDLLKVANKKMKKLIHTGNSSNKKE

SEQ ID NO: 409 - protein, 415 aa, Neospora caninum
MDNSETHYVSFLNGEGDDGLENGELHQRRGVRAGGVAATPYVVTTRTYFWKKFLRQRNFKTRAWIALVAAAVSLLVFASFLIQWQGDDDRGVFPPSPVEDHKTPVNIWEWKEEHFQNAFGSFRATYGKSYATEEETQKRYAIFKNNLAYIHTHNQQGYSYSLKMNHFGDLSREEFRRKYLGYNKSRNLKSNNLGVATELLKVSPSDVPSAVDWREKGCVTPVKDQRDCGSCWAFSATGALEGAHCAKTGELLSLSEQELVDCSLAEGNQGCSGGEMNDAFQYVVDSGGLCSEEGYPYLARDGECKRACKKVVTISGFKDVPRKSETAMKAALAHSPVSIAIEADQLPFQFYHEGVFDASCGTDLDHGVLLVGYGTDKETKKDFWIMKNSWGSGWGRDGYMYMAMHKGEETVPLDF

SEQ ID NO: 410 - protein, 778 aa, Neospora caninum
MGDDNMHTRRVGHSPGQLRHRLAFSRALLKELLRHSLLVTLLCCCERHFSHGGIQETFHRFVSWPHMDSSRNEFYSSTTQTAEDGLPNLLMVPPAEVEPQQAPLATVGRSTVCALPMMRLCPQCDCRRLLQGFAELPDGDTTRTHGETAMRGNGATGSESRPAPGTESRTNPGARPRELSTRQSPSPNSISGADGSPPTSPPSTPLLGRQRHNSSGREAVPVPPRTASFGSWSSALPPRGPLLVRHWRSLSARGGRLREEATLSVSAGWSARSRRRDTLHDITGSAPSHTADGTSRTASVDTGVPHSESRRQQSSTVGERPDRNDEQAPTHGGRSSLFSRINDAVLSSARMAGAMLSRRRSSSISQASDTGGARRREASATRPVEISSPIIPWINSDREKKGETGVSGLSSPTRLSSPNPATPPSDLTYMVMLPISVDPPEPRDTSEYVPFAPGGTQETGTVFGASGGGAEGAPAGEHVMKASYEPQVDLSKTTYGDKLHTWRRPLSTLREKPPQPEGAADLEHLYEEVDELFEDSEMRGYAAGRPTPRSREGSSSGELPQAGATPDPEHLYEEVDELLEDLELRGYAAGPPTPRSREGSRRGRSYSYPGNARGPQPIYDTPRSTPAFSVVPNHFPRRPTPRSHVDSRRGDRSLSYPGGARGPESIYDTPRSTPAVQRVPGHKPRRPVPQPPLRFGRGSPLRAGPSPLPHPNHQLPGATLPVSPVQEHIPGPPVPHLVSEFQPDPAPPPRLPPVAEAVEPLPESPRGSAGDGGDRPAS

SEQ ID NO: 411 - protein, 1117 aa, Neospora caninum
MELERNCTLYIYSSRGDPPSTAELQKKIESPNEATKAEGMQDLIVGMTQGEAYTRLLMTVIRYAMPSKDKQVKKLTQLYLEIVGKCRPDGSLKEEMILVCNALRNDLMSPNEYVRGSTLRLLSKIRQFKVLEPLIEAMLQNLTHRHSYVRRNAVMCVYSIVKNFGLDAIPAAIDQVEQLLLTESDLTTKRNAFLVLVHCASKRAIQFILQQRSEDGTGGLGFLLSSGDLFQLALLELLRKVCRQKQQQKAGLLRLIISILPSALPSVAYEGACSLLALSRSPVSLKAAASAFSSLLCGNSDNNVKLIVLDRLQECVQRATRRTMEEFVIDLLRGLQTPSLEVRRKTLDLVLQIVGRNSIEQLVNVLKRELLRTAEPEQLTVPKTMEYRRLLIKAVHSCCNRFPDAAASVVNVLIDFLSDVDVTTATEVAVVIRELVATCADLRSRIISRVVDAFPDLAHPRVLRVSLWILGEYCEDSELLDAFLTAVYTACAPLPFTSGETPGAEGEHRSGGSQPKLKLTTRTVVLEDGTYGTEDVYETVNDKGESSVKAGKSALRKFILGGDFLLASTVAVTCTKLILKTSDEVHAQLVEEFERHREAVLRKKAETHANQPNGDAPCLCDGEQRDQADERGEDRAMPVKLRASTEQKTRVLYLVACLLKFLRHSSSGAGAHSDAAIRVGQSLRALCGLMTGVEKEKAFVRHWIHNGRFALEHVLALGPQSDDPFTWSLLKDAGEDEQAVSAPDDLAFFRQLRPDRQSLLLASDGAQGASLGEGDSLEEDEVYYSAGAHAARGAGELDEVDETEADLQLTVGGGKNNSASVFAGAKDEAALFQQRLAKVQPITGQADPLYVEAFLQVNQFDLLVEMLVVNRTQDTLQNVTVELSTHGDLKLVDRPTPVSLAPGQQAVLHAPIKVRSTEAGIILGYVTFGRRGSSEKECLVLNELHIDLLDYIERRWTGELAFRSMWAEFEWENKIHVNTSFTDVSDFLEHLMKMTNLTVVGFRPPANVLRRLRSSAATSALAEGDRASGDGDEEDEDRYLQSVRKIPTLRKLSESSSFFAINLYSRSIFGEDALVNVSIEKLPGGKLAGSIRIRSRTQGIALSLGDRITVVQRGLAK

SEQ ID NO: 412 - protein, 237 aa, Neospora caninum
MASAAFPAAASRARASAVFASSFASVGSSARFFSSFLRASRPRLNATTPVATKALERNVPMKEILQPLWVIEPPNFLRQPVWKQFWEAQFANRSFFFFGNAWTSAAAFALFIWWSRVFDPPPKERLDRYWLNSPKFRILSAFHNPGKRPGLKISLMTYEARYCYRGLDHPFTLNEVKDFLFKLREQYLVNKYEGIQFPFVFRQFNRVSTPGTLEVHTAPALQQQPHFHEHSGDAEHH

SEQ ID NO: 413 - protein, 1613 aa, Neospora caninum
MNAVSDSPSPHGEGEKEGEKSVSASAFGTDAGPTDSAACTGQETALSSESRDVNMDDMSPGNEPTSEGKEDREEDEEDDAEEMREEDDDEDEKEDDEEGLREGEEETMFGDGPENSVKGEYGLANAELEAKLRELLRQADTFSSRIHGGGNASAPPKTKGPGSRSRERRMLSEAEEDDILLRRLEEDSGEAEGDGASQGDVFVRITEQPSCIEGKMKHYQIEGLNWLYQLHCLDINGILADEMGLGKTLQTISILAFLQFEKNIPGPHLVICPRSTLDNWFNEVKKWCPRFRPARLHGTKEERQELYDTVLDPGHFDICITTYEMVIKDYHRLASRFQWNYLIMDEAHRIKNEKSVLSEVVRRFRPRRRLLITGTPLQNNLRELWALLNFIMPQLFDATLDFAALFDFSRLNTEQQQHQVITTLHRILRPFMLRRLKSDVARDLPPKREIYIFVGMSKLQKKLYADILSKNVEVLNAMSGSKTQMLNILMQLRKCCNHPYLFDGVEPGPPYVEGEHMVEAAGKMALLDKLLPRLKAEGSRVLLFSQMTRLLDIVDDYCRWRGFDYCRIDGGTPGTERQERIDEFNAEGSSKFLFLLSTRAGGLGINLATADVVILFDSDFNPQMDLQAMDRAHRIGQKKRVVVYRFVTGDTVEAKIVERAAKKLKLDSLVIQKGRLSQSNQAQKGPSTNELHAILQFGAQEVYRTQDESSITEADIDVILADAEQRTAEIQAQLTSLERTFDLSNMSLDGGLHMYGEEEDELRNQPRKPGRKKAVKLNRPATFFELGDRKTKWRGDGGAAAMAMVKKERKLSRKALTGWRAEINGGYDFQFFNADQLDALDAIQRNWQAYLDNRRRKLLENLKRERGSTLASAAGAKKEAETAEKGEKGDEAPPAKKQRTSEEEGAKAVLGDFQKPAAADLLRACEEPVETEQEGSDAWTNGVEHLTVPQARQVETLLESFAAAAGLSLSTFDGKNAEDVEMEDASSSSPSSRIEKICRLLRPAEDKAQKSVFSTEAPSFAAALKQLAEDFVSGQAAALGVPLAVAASQRFAASFSAGQPDAEKRGVKREREDSKEDSKGESKEDIKDESKEDSKDESKEESKDESKEESKDESKEESKEESKEDNKEESKEESKAEIKEESGGPAPEAEDEAPGEEEDGEKPSPPPSVGGSPAAEEGTTVKKKAGRPRKNVKEEERGVDEDEEDEALLALLKEEDLDDENDPDRPEEFTEDMRKEKDRLLAEGFGNWNRTEFSKFVSGLIHYGRDRLAEAWCAHFRGTNKSLEELERYTEVFFKRYSEVEGGDRIMQRVEKAADIRGALDSQRRAVQAMVEEQLREERTDGGVARPIERPDELRLPKRLAPSAHFTPQEDAMLLWGLYEQGVTAYAAIHALLKYYWFDSRGFFHVASRSMKQVEDRCKEIVMAIELEETAKTGQKEYMRYRQFRPTSHRIGRPPTRLSAGGRPGRGHASQCSRSRDKNGENLFFPGDEGEEGRSVCWENEEDERRDERRDRLFSEGAKNPEGRGGSQKGRRCTGRKRGRPRGGRGRNSTRGLAPSHLSPGGVGAGVGSGESDRGGEEQEPRPEGEENESGREDVREKVDEEKDGEEESKTAA

SEQ ID NO: 414 - protein, 96 aa, Neospora caninum
MAKRTKKVGVVGKYGTRYGASLRKQVKKIELQQHAKYSCPFCGKMATKRQAVGIWKCRGCSKVMTGGAWTLQTAAAATVRSTVARLRKQIGETQTV

SEQ ID NO: 415 - protein, 545 aa, Neospora caninum
MASSRSSWCSVGASQGRFPPSCRNVGPCGSAFSGASSRRCIASKCPSCGPVRGPSCSPRSCRSVSVCRRDAVDRLRLDCSSTRFLLFLVLLPLLTLFSPAAVSSLVSFSPSVSLFVAAESRADASAEPSSPEAGQAANSISATSEADKKTDDSAEEDKTKRTEEELKEKAREAANAAADAAAKALELRVPLPSLVTATAGAAAAQTTDQKDAGVATQAGTSKVVRPDDLRYQNTPENPKDGDTAKKEEETPIPVDGGECIIFAAEEGDKDSCSCPKGFVLCNVQDVQAVRTRLAKIEQAARAAAVRELLLRLDKLPAEELQKAPASSAKGSETGDEASGAPTAKTSGGELRGSANASGDQAAEGTGGTDEEERREAMLPPELAEYAKKAAKTAMSLHVPAWVKTLCDEDEKTGFKSYGVQIDYEAEATCTDSGTKDEPAVDFLYDLNTYVPLDRLHKLQKKDSSWTPRHCLVADFYLCKRLPAGREKVHCEISDWSEWSTECLDNTQTRKKIITRSGQHGGRACVWDGKQPVHAEVTEVRSCSES

SEQ ID NO: 416 - protein, 429 aa, Neospora caninum
MGLLTLPHWFSNVPWLHVYLGFSLSVECFEQYLNTRQLKRYDAPKPPAKLAHLVTEEEYAKSNAYNKDKMRFGIFSSLFQTSISLISTACFLGPYLWRLAGTLVGKNGNEYTQSLVDLALSAVIGECISTPFQLYGDFVVEEKHGFNKKTLALFFKDKLLSLGLTSLIGGPVAYAAIWLINVSVLTQLWGFSVATVIAMMFIYPNLIAPLFNKFEPLKDEELRGKICDLAKKLDFPLTKLYEMDNSKRSGHSNAYFYGFWWSKRIVLYDTLLHLPHDQILAILGHEMGHWKKNHTTKMMAVNFLQLFCTLYLFGLVMGSDALFDSFGYTDTRASVVGLKLFSNIFLPVNTLISLMMTIYSRKNEFEADAFACELGYSEPLKQGLVAIHAENKSCLDPDPWFSFWHYSHPPLLERLRAIEAIQEKEEKEN

SEQ ID NO: 417 - protein, 372 aa, Neospora caninum
MQLPILYVVVGVVIASHVHGMEDAGNSRPSEPGAGTGGTLFQNEPSVSEPNIAKATVDISVNSAGTTTSDDLVHEGVKKDDTAAPRLVSHTAVQKSRPGGARSWLRKRWVYAAGVAAITLLGAYAFRKARERRRNNRRTLAMAASYLRARAEASGRIAQTLQKKERAASWFIPNARNAVMASVNTPRHEHEKEMREGLEMIVGMLESQRNVASTIHRDLSNASNIIARESTKLGKYPLTEEEEADAVERGRIAEAEDFLNRFLAERDRLRTTLTPNLVRLESELAEAERRSSPTWNLLADQLVEAGKGRTAKRLQSYVGEVVSDLPSTVGMSTADFRAHVSELGGQEPQYVVLAKEKLNQLRTPPVSDSDPH

SEQ ID NO: 418 - protein, 1035 aa, Neospora caninum
MGFSIGDIVAVYGRKAHIRYIGQLPPNPFNKKHNASQTGFGVEFSSRKLGENDGSVDGKRYFNCKPGMGLFVKENRAQAYDVKECSATQLQAAWRSYRARQAFQDAAAFNFWNELDAFEEKDALVNNRDVGTPTLNTIKKQIHEQNMVDAFEETGPERVSSSHLAVPGADGSRGFAPPRGRRRSSTRRSVGRNSVDASSISAENIPDDYTGPRVKWPITREFCLDLIDHYRDNPDVPLPRKYALELIMAVADHYRETMKGAVVEVEIPKKSGSRLVLVGDTHGQLNDVLWIFYKFGPPSPTNVYLFNGDIADRGRYAVEIFMMLFAFKLQCPSSVVINRGNHESADMNEVYGFAQEVRQKYGGFMYQKFQEVFHLLPLCVVMEKRVFVVHGGLCRKDNITLHHIDRLHRQRPCPASPHSFEDTLMFDLLWSDPQHESGRGWSTRGADCIAFGPDITDAFLTKNNLEVCIRSHQVPTNLRGFEPVHDGRCVTLFSASNYCGTTGNYGGVIIFEANLSFEIQEYMAPSLAEIQMLHSETCAATQKVFLQTRIKDLEMQAKRQHRRTAAARMNEQILEKICKLICEKKTDLWWCFFNMGAESGRVKPAQWREACSNVLGQNFPWVYLMKRLHVVEEDGYVYYNEFLNRYRVEFRPPKCKHLNWRRECIARVFESIMSADLSLKETLMLFDRNCDGTVSFREFNELITELDVGLSEPQVRILMRLITASPAFNAAAGSIDVAEFLGRFRVVYSHVINDDKRNVPWLQRALHCIGKAILADKAEAANRHYEQQRQDGNLGPETNARRRSSAVRAVALFQKFKDYNEGGDGYLSYADFVTGIKRLTIDEEELGFALTDEHLYKVAEAVDTTGSKRINYLEFLQAFHVVDSNSNNSAAEELWGQICTAIFQHKSSIRRALHQFDPDMTGKVDSEDFRSALVAVNTVLSRTEAPLTEEQIDQLVNTMDLDNDGMVEYEEFLDSFTPVDTFFLQPENEDEPSKANGPQNGKVETREGEDPSQADVDIDSNSQRFTISSDFSSSA

SEQ ID NO: 419 - protein, 200 aa, Neospora caninum
MPAPTVSQPAPAFEAEAVMADGTFGKISLDQFKGKKYVILFFYPFDFTFVCPSEILAFHRLQGEFEKRGCQLLGVSVDSKFVHNAWRNLELKEGGIGKISFPLLADVSHKMAADYGVLLPEGMALRGLFLIDKDGVLQHSVVNNLPLGRSADEALRMLDALQHVEQYGEVCPANWRKGEKAMKATADGVKEYLGSSFTSN

SEQ ID NO: 420 - protein, 80 aa, Neospora caninum
MSRAVYAKLWASTAQYTQRRHYAWYQIWSRVIPWSVPWGIFAMWMVFPAMPVEYRQALTFGIWRKPNIGTHGPDPADAKK

SEQ ID NO: 421 - protein, 214 aa, Neospora caninum
MADSSKDKDHYDYLFKFIIIGDAGAGKSCLLHQFIENKFKKGCSHTIGVEFGSKMINIAGKRIKLQIWDTAGQERYRSVTRSYYRGAAGALLVYDISNRDSYNHLMNWLADARSLARADISIIAVGNKVDLKEKRAVSFLEASRFAQENDILFLETSAFTGEGVEDVFVKVARLILNKIEDGLIDPNTMISGIHATRTSMGSPGPKPPPSSCSC

SEQ ID NO: 422 - protein, 465 aa, Neospora caninum
MANATTDHLRPQDLETLDISKLTPLSPDVISRQATINFGTIGHVAHGKSTIVRAVSGVQTVRFKHEKERNITIKLGYANAKIYKCSNPECPEPECYKSYGSSKEDDPPCPRPGCGHKMNLLRHVSFVDCPGHDILMATMLNGAAVMDAALLLIAGNEPCPQPQTSEHLAAVEIMRLQHIIILQNKVELIKESQAQQQQEEIRAFVAGTAADKAPIIPVSAVLKFNIDILCQYICTLVPVPVRDFTSPPQMIIIRSFDVNKPGEEASNLQGGVAGGSISQGVLKVGDDIEVRPGIISKDSAGNIQCRPIVSTIMSMFAEENPLKYAVPGGLIGVGTNIDPTLTRADRLVGQVLGHPGNLPDCFGEMEVSYYLLRRLLGVRSQEGDKSTKVSKLKKGEFLMVNIASTSVGARVAGLKPEMAKLELTGPVCTRVGDKIALSRRVDKHWRLIGWGQIHKGKTLPLLESL

SEQ ID NO: 423 - protein, 678 aa, Neospora caninum
MENENGSAGVGTPTASAVAALAKAKGAGLASPLLGGPLDGAQVSALAGKETVPACAAHTPSGSPAQKPGTVSPATSPVLAGSAATPAAKGDRGVSPQTLAANALGGACPNAASLAPLTQPLPHNAPPVEIKLFVGRVPQTVDEDALRPIFEGFGDVREVFVIRDKNTLKHKNSAFVKMASLAAADACIRALHSNRILDAALGPIIVKYATGEAERLGMHSLGMGGEGGGVDQAKLFVGSIPRTMSEDELRVFFQTYGTVEEVFVMKDSATGTGKGCAFVKFKYKEEGLHAMRNLNGKHIFEGCTRPVEVRFAESKSQRQQQMAGQHNLGGLGGWGGGGVMTQAGLSGMSRSASTLAGSNANPRQAGQWKEYFAPDGRPYYHNEYTNVTTWERPPEFDHLPLASLALGGNQASMFSGGVGLHHGSVNSGIGGSETAGPPGANVFVFHIPNEWTKADLIQTFSGFGNIVSCHIAVDKVSHRNRGFAFVSYDNVQSAANAVNHMNGCLAANKRLNVSIKKGEEHHVQHLLNVHGAHAQGHHLGPNQHGKSQSVSGSASAHGMHPHGASGSQQGSANASLSGSGAVVGLGSPLQQAGGQSASVSAQGGQGTGNVHASLSSHLQLAAVGSPASGMMSNSPQMGGAGQAFSGHGAQQQTWGAGGPGSGYGQQAYGAAGQRFNAY

SEQ ID NO: 424 - protein, 352 aa, Neospora caninum
MEARDGVASSQAGAAGAAVPKADLGDCRFYEERFPDVEDLVMVKVNRIADLGAYVSLLEYNNMEGMILMSELSKRRFRSVNKLIRVGRHEVVMVLRVDPKKGYIDLSKRRVSPEDIVKCEEKFSKSKKVHQTVRHAAQKHGMKVDDLNRSVIWPLYRKYGHALDALKEAAMRPDEVFAGLEVDEEVRKSLIQDIQLRLAPQVLKLRARVDVWCFGKEGIDAVKAALQAGQEVGDSEVTINIKLIAPPQYVVVTSCYDKDLGMRKIEEAMKAISDKIKSFSGGDFKQQGEIVVMGGDEERRLEELLEEAGEDDSSDDEEEEEDEGMGRVEGDIPEDEVEDDEDEAEDNEDAKA

SEQ ID NO: 425 - protein, 388 aa, Neospora caninum
MGECVLLAVCLAVFVAVLMSFDYRDGIKFPCIFASDRESRREPNFVYSSEAETFVNRSGAVCVEDIVTFVNKRRMGPDGEVGTKDDAMTLEEQVTMISAMLHANFHGGFWVNTPWTLKYDEGGATWAKLIYADGDEYILISGSRTGYNGVVYESHVTKSYFALEGALRLQRRAPHRPVLIAPLLSRRGVEARIEPVGSEGELWKNGFRIRKGQKVLYSTESQTEGAVVLQYVYGSMPSAAMWSFILPPLFKAWDWEASFMYLRALGESFYRNGLLPVIAFMLDKEESWSARMNLSYLSDSEQSYVYDAEREEEETGEDIAIAGGQQAGNPKEAASGPTKSRAPSGDRKTENGDPSPTREDHSGKEDKSEEQDVEDEEDDEPLTRDDEL

SEQ ID NO: 426 - protein, 585 aa, Neospora caninum
MEGLIRPVVAFRRQNIRSRHFFWLLALISMFLLLTSWSYRGRRTISWAGIPRYTGFAEAAGQSADSLGGSDRLPQERGMQPRRLSSIVKKFVVWEPVHRLMPSLNLDSVVFVAGKHKADRSAAFHATMDDVMTLFLRWFNENGNMNWLLQSFVTEAALLRAHSRYQDQMIHEQTQSESERPTSPEDNMNKLLNVEVYTYLAAAKRRVRDWVCDGNSFLRTGEEGRDLAKKPLLTERDAGFLRGLPYSVLRVARGVYADTLPASVERLQEELYHRDVRTVDDLLMKTNIIDLFVLFDVTDESFTQIDVLREVARNWELAREGRLVPPLLPPGTWKGKRSLEDLIRDGHYPSMKFPKCTTLKCVMQETWSEHSVDTISVEKTDTNSLKLLLVGNTGIGEYKHRAKRKGFWYSLKRFLWANEIDQVVAALKTWHEKEKADAVLGLGDFFGIPGPLSARDERFSTKWYDVFVKDAGLDIPWLMTLGDEEALVNPSASIRHHYTQEHQNWYMPSDAYTVTFNFTANMTMADGTIQQESFNATVININTWSLFVGNPVGESSISRNGTLLVCDVFLPFCSFPSRLRFEKHM

SEQ ID NO: 427 - protein, 476 aa, Neospora caninum
MPLCYCSADYLSASRLVQLEPSGGECATATTRARALQALEATEESVLKRVQEAGNSLCCLRRRAWVAACRAAQTLAPRSRFAKRLTSTLVTRLTIQSLLYPIDVVRCRRAQGMAFKDIPVGALYNGCLSILAMSEVPYCVLCVTLQTQAQKLLSRHAGKLPTVANLFLSAIAADSVGSVYKTPFDCAKRLLQRGKATSAQEALTTVLRDDPSTLKTTYRGFYAQVLRDATHRVLNGHTMQALRRVIAARQQAQQGPRRPLQSGIVAKAAEKMRLTPGEDSPQMSLKPRGEGKLNWARDLLVHGMHGPLTAVRSLATRLTNVRQANRRRQGDAQVEEHADIAVEQAGRNPSAPATPAGTLSPPSAAPVTLGVGLLSGAFTSFATSPLEAARRYIVEKSKEDPEAGPATRLQGILGVCRALYELAEQEGVLSGWFKNAPTRMLIANEGIKEPKASHYRVTECDEGGDMHMITRVTTKT

SEQ ID NO: 428 - protein, 660 aa, Neospora caninum
MADPSSNFAAPYTYQYTQSAGCIPTTTSLNQLAPIYTPSPSGAFRASSQSSGSSPDGGRGQGWTSLSGTGYDTPICSSGPCGNAGCYSAPAAPHFAGELHPLIPSKFKYAFPRNKILKHRSYEVLAIEEGPKDVRNSSYGRSVYGADEVLGRVKRPYRKKTIFGIARRTDANHTHKQEFAGIVGRGSGLPSGQVSRLPSDPNRAWSATKKMDRATLSENAKTSQDAKKSKGWMRNWQCFLCTSADYVSTEQAALEEQNEHLDEALTEFQETNRIQAIRLFETENQLEKKNEALEQLQLQLEYETAELKKKNMALEKGSKIAEDSLNELREKVVKTIETVCTIRESADTSELDAVLRDFCFEVANVLNAARESGVPGPTIIIPAASPLNQLGSPSAAGPVRRKVVKKGGKAKKGLKKKGKGGKKKAVGKKKKGAKAGGARKGKAKGSGVKGTKGKKAKGASGAIKKKAKSGRKPAKTVARRAKVVKKKGNSESISSGVSVPVMLGYDVAVPQSSSPYLLQQISQMQHQSGERPSLPSSTHSSRASAPQQLGVAGIGTASSLQFLLYPGFLESQSKNLGTASELHQSPSTAKGSLQSEPQHLPSDPISLANLMIDKQLAARVLDSPATTVYQCEVSSVHSESHPEKAPPEALDAPNTRLISV

SEQ ID NO: 429 - protein, 870 aa, Neospora caninum
MDGKREDVSRASPAVAASARGDEGKNSATNGVKVESQMYQQLRKLINVVDELRDVGLQQFIQLPRICVVGTQSAGKSSVLEAIVGLDFLPRGDGVVTRRPLELRLVHLSEAEHDLNEAYAVFENDKGRKIRDFEQVRQEIDRLTDQVAGKNKGIIDSPIVLTIYATQCPDLSLIDLPGITRVPLKGSDQSEDIEMLTRQMALRYASDPRTIILAVIPANVDMSTSDALQMSRRVDPRGVRTIGVITKIDLMDRGTDAAKMLMGEEIPLRLGYTGVRNRSQADIREGKSVRECLEEEKTYFATHPTYRLLPPHLVGVHSLVDKLTKVLFRHIKNFLPEIKREIASKTRVVLDRLQELGEGVPLEPSERAQLLWTAITDYVEIFKNTIRGKYDKRLQMYFDHQKDITGGSQIRTIFNELLEEFNDRKVTEDISDYEIDVAIRLHEGDSLPGFPSPDTFEYLILPYLKRIQSPVMECLDRVSQTLELLSQKIANRVFGRFPALAEKVLEMSQEILIRERDHTKAILQQIVDAETGYLFTNDAKYLSEHGSMISQESPEQVPGAYAQQGTGAVQLYGADGRPVQLGPDGKPIPPPTHAERAQQMLSSMQQSVTTMWAQGGREKKKTVYSEQFIREIRRRLDSYFALVLRNVRDSVPKTIGFFLVRQLQEKLQFEIYNQLNDETQFSALLGEPPHIMEERRALMSQLQTLKRASAVLQRDPTIAALNLDSVDENFDRDLRDLQRDASSRALPNLQSFSAPSGGSAGDGRGQMFGGGIQQRPDGAVNGAYMGSSQRPNGHATSSASPTAPGSNASDAGSFSPVTGGMVAAGSLPDKTRTLVSSGVFGDQKGASASAAKHVFEKVKFQAANNPLFSD

SEQ ID NO: 430 - protein, 543 aa, Neospora caninum
MGKPKSQVRDSSLGSGLGGSPASSVAHPTSPNGASEASKNPKHGGWSQRAEGETAEEKLGGCSGVQSRYPVMTEREHQVLRQLQVAELKRQGPSAVRSFVESLCLAVYVAFLPGFFNACLRRFPPFNAWEGGTTSALALWACLACWSALFARGNVTDPGGFLVGVREAKTWSREDRHLRVLAQQDLLGAAGARAASPIRRNADGDAETESADEALARVSVGVFCKITAASLLGATVVGLVLRFFFSEATFLSPLEPLPHQVYVDLPAPVPGKVSPPFFLPSSSLVASLLPLLPVALQLRTTEMLRSGLVLASRLFALLRRVGLGVCTAGIAMVLKPGGGHQQFQEQMIKSDFFKQFFGEVSDASRDSAHGFFGPSLPDNFFSKIVHTLTGSAAGVKEEEMAVLWVSGIVDMFLLEVFFGFLAYMAAAVQASVTAAAQGTRFQIRGISYASLNAACFFYYFGIPFCTPVGGPMLNAGYAALVTAYRLDVIGFFLLVSADLLAAYLATLVVRPFACVPEKKPAAPDKVDRNFSVWPEQREKRKAE

SEQ ID NO: 431 - protein, 155 aa, Neospora caninum
MVANRQERTYIMVKPDGVQRGLVSEVLKRFEQRGYKLVALKMKSPDASLLEEHYADLKGKPFFPGLISYMSSGPVVCMVWEGTDVVKQGRRMLGETRPLESNPGTLRGDFCIDVGRNIVHGSDSVESANKEINLWFTPEEICEWTSAQHKWVYEQ

SEQ ID NO: 432 - protein, 1392 aa, Neospora caninum
MENNASSERGKNQPSSTAAATDSAGVAFDAHIYGETPAAHYVTEIDAETPLVAQDGGSSALAASRGSRGGQRAAEDSARIAERERMLLAQQGDGFQEGTGAVEKSIAAREDFYRRQRFQRPLSPERADPFSDGDLGTESRGGESARTYADVMLEQHLDREKHAAVRQIRKLQEDAELQRQLQMQKGQLGAGDGSEKKRRRWDWSTAGAEGVEDGLTEAERQELARAKARGAKGEEGAAAAAAALVSRWDTPLQAGGQTPGAWGETPLVAGSDGTREGAGAGRAGAVPGKKKSRWDATPTIGGTGQETPTPGQWGTTPAVNQAGTPILAGAGSVTPMASGSGSVTPMIAPGSQTPIMGRKRSRWDATPVLGGSDADMAAAAAAGLTPGASTPMTGGAGMTPGKDGSTPMTSQLTPGMTPLAVTGMAGATPLTPGTPISTAEQLLQLRMQQEQDERTRYMTDEELDRLLPKEGYEIVPPPADYNPPPSSAAAAAARARHQAIGMTPGVAATPTPIGVTPLYTMPEEGVIPGGMEGLMTMGGGIGGQLTAEGGGVTMKAEDYQFFAKLFEDKDEETMTQEEVKERKIQLLLLKIKNGTPPLRRSALRTLTEKAKEFGAAALFNQILPLMMQSTLEDQERHLLVKVIDRVLYRLDDAVRPYVHKILVVIEPLLIDEDYYARIEGREIISNLAKAAGLATMIATMRPDIDHPDEYVRNTTARAFAVVASALGIPSLILFLKAVCQSKKSWQARHTGIKIIQQMSILMGCGVLPHLKQLVEIIQHGLDDQVLKVKTVTALALAALAESAAPYGIEAFDSVLRPLWKGMGEMRGKGLAAYLKAIGSIIPLMDAYHASYYTREVMVMLVREFETNDEEMKKIVLRVVRQCVATEGVESDYIRTDIVPPFFAKVWLVRNALDRRTAKLLIETVVEIANKAGGAHIIQQIVEDLKDPSEPFRKVTLEALEQIIVNNGVLDVDNRLEEQLVDGLLYAFQEQTSEDATALLNGFSTIVNALGTRIKPYLPQICGVIRWRLNTPSAKLRQQAADLIARIAVVMQKCGEEQMLGHLGLFLYEYLGEEYPEVLGSILGALKAIVNVIGMNKMTPPIKDLLPRLTPILKNRHEKVQENVIDLVGRIADRGGDLVSPKEWDRICFDLLDMLKASKKAIRRATVNTFGYIARTIGPQDVLATLLNNLKVQERQLRLCTTIAIAIVAETCLPYSVLPALMNEYRVQELNVQNGVLKTLSFMFEYIGEMAKDYIYTVVPLLEDALMDRDLVHRQTAAWATKHLALGVHGLSCEDALLHLMNFVWPNIFEKSPHLVQAFFDAVDGMRVSLGAGIVFRYVLLGLFHPAKKVREVYWRVYNNLYIGHQDSMVAFYPPLPDDDKGCYSRDELLYVI

SEQ ID NO: 433 - protein, 4555 aa, Neospora caninum
MDLFPQDVLLKTKETSNSSQENRDLLSLASPPSSYHTSSDASDAEGSQGELPFISPCLHSEASGVQKATPGTSPGYRATAPPSPCLRRSLSRASLPSLDLGPRSTDPPAAASLRTASGEATLADKLCSGTRDLLSGVARDGPATESFLTRAHERSASSLVSDLRASCAPACLPAVDDADNTRPCQTLALVSTLDPAPSATELSSFSWPPSPSGDCAGGGGSPSSTAADCERTAAGDPGEEEARESVLQRAPSLPALFFSPETPAERLSPLSDASASISAASSGSKCLASSELASSDPFSLVPCLASDPREATHSTVPSPSAAASAFPVFHPPVGAGDRVPSAPSLASSEGPGEQACLAEASFPAETVESPAVNGDNSVLSAPGNARQRDDTAPRLAPVRCGSSSAHWPFQGGSEKETAEKRGVSSTADVSAQVSGSESDASGAAESRLADPSLQLQSRDQAPGEERPSDVREKENAELASAVLSAPDCATERSDRGTSESVPTQISLFFQSLPGETAVVPSDSPTGCSAISADSGGETQASFYPQTRGAIEAADAQFKLEREAESREREGPDHARDGCKQAEAEAGACGAVLPVFHTDVEHVGASEGDGEEPGEDSRLCCQESGILEEAEDAEVQQGLERRICGEVRSGSRSVSQGELEDETETEEEGPDGESESKAFLSSLFEFPEATECPNLDQRDSEVAGEDGFEGEQVEVETCSRIRPSEEAFALDERGGEKETEDRSGNFEADGGGSGDGWLGAAGKEETQEGQGHSEEQVGVVSTPRGDRRSLQERDTGRGREKEEGEDGLAAAGQGAVVDEPGGSPSAEEEEGSGAEGQGGAREQEAEERKEDIHEEDETVGERGNGEPRDASDARSDEVEGDEEVEVARRALGELATLDENEENEERGETEPGEQCEAHRPVEGGESSGDSSGEPSGESSGESLEREDGEHECATFFLVGSLLEKDVQDLAEVEESPAEERDTHQRSSFGEDREAKLADGAVQAEGTTEAGKAFGQLEAEATALRSPRDDESECVPQESQWLSIRRSSRIFSEPILFSSLLSGAASVVEDSSFPDIAPGTQDSQAKGEEELQKLERERQNPEEERLPVCAPWEGKNAAQSAGELGEPDASCALSETLNKQGENGRLCAPAFRSESREGVEETQDSGEEEPVGPRETPPSPSLSLLGFVSAVGACDLSGLDGPAAASLHPESVTEGDSSCEATAQNIHALSVLSEEPSSLAPISAPSGDILLPPGPSRLPSVSGSSSSPACAFLAPAGAVTSGPEAGGEDTREERTPCEEGDAATAETSGSRSEAGREQEAHRQEDDRGEGRVSGEPQETLDSREAGQPSTSQTADAPEDTRASETPEAPDCLSEGTQEAAGASGNEEGELGTLQTGEEKRVEEEEEGVQEGEQATSQEQEEERGQEGEQETDPDDAQGIRQEGGQETSLEEAQGIREEGGQETGQEGKPEKLPKREHEINQEEEQASLQENEEEREREDGEQEQERGQEEDRGTVDEEESVREGSLGDFEGAKELGDQGRVSDSGAEIRACISDALESLPSVYAFVQTTVADLAHSQVDGKVACEAQDAGEEKDKKEVAGEREVTSEESERGRAGEIEAHSEGETDEQGEEHIDEQSEEEREGQGEEDIDEQSDEGIDEQSEQDIDEQSEDDIDEQSEEDCQEPSEEERAERSEGETDEQSEEEREGQGEEDTDEQGEEDTDEQGEEDIDEQGEEDTDEQGEENIDEQGEEDIDEQGEEERDGEGEEDIGEQSDEERGEQVGESEGGSDGSRASSVFRFPVPDETRPSESRSFAEHFLICTRSPSELSRQSSGSTLRSAAVLFSQTPAFATSQEPSSGYPPSVATSFARLQFSARFADSPPSLPRALPEPAAANSPEREETGETKHGEENEESRSPAEQGLCPGVESPLGSEPKLGREDLPAVSTWPLVHLVPDAFPAASEEPHGESEGQTPVACAEVEGEPHRGEGPTSRFGSPVFGTVLASSSVSVSSVELPLGSEAGPETTPAPSCLHSPGWSASVDDSLVPLASALSPVWGCPSKTDSPVSCFSFSAKRTAGDGQDETAAEQEAEGLDRATPAGGSAPSRVPQAVEPTPCSLSASFSPSLSAGVAPSSSSQASDEAKLGRAPGASSFAVGTSRSLSQTRVVRRVVLSPQAPRAPLESRALSASGAKLVADNPVGLPACASGERSVVKGRPLRSGKTLSGEETDDVDREPADVSRPRVGQREDSFSVGTAILSFSRPAREPSFDSRTRSGSAASLFFLDSGEQERATLPLSARSRQRSAPRASQAAAGYTLSLPSSCASSSSPASPLPDILEERGEQLQESGESPSPSAASRSPSVGRLSDNAKSEATPVGEGAAQSSRSASARGRSGRPSSASKKRNASNKKEGKASSRSKRDGRRRLREREVAPHEARLPSPPDTVLPRKFRPAPIPRRDQPGGKEGELDSSAVVAESLDAQVQQLVLSPTACVPSPRHQETGSPSPCSSSPSVVLSRSVPTPDSGGTECAAVRLPTPAGRSSASSLSLSAESPRKRLKESDFRQTEDSAPPPPRAASSLALEGHPTAHDVGSSSSSSTSSSSHSSASPLSTSSSSFSASYSSQPEHHSDRNPVHVPVQFSDSAVPFHASAVSQSLLPATQSCFGVIEESSALGSQEQPSQASHSSCASRSHSAPSESPTKMFASSPRSNSPEFIVPLTRAEAEEMHLNNPRTGRRPWLCGNTGVGRLSGAGSPRKSAPRKLGETRAPAGKGGVADWCSPCCGQAQGGSPLAHAAYPQYVVSTASQGTVASRYGPGTGVSRPGSPARVYYARPEAARPVRHVNPGAAPQAPRAGSVAPSPAGAGRSPVSPTVRGVSASPRCTGRRYTPGASPRSVGGTPHMHTTARVWRSVTPPRSRSSAPAAGPEGFKTTVYPAYQAGTYVPSCQGMAYAVHGATPADAAGANGAPRPYYVASAQPNVTSVAAAALQPGCGSPSVSKTVIYQSARSPYQGIRSAYTPSGPWCVPPSHPIVSTVPTPSFGPAGVSQAPAVASVPSVATGWPRTFFGSPSDSDLPPSVQISPPAPPVAGLSSSTGQSTSPQAEGGQKQEAALSTPGTAPLEAPRTPAASPLTPGLSAPSPAASTASPAASTASCRRLNSRPLEGAGASGLSGTFCSLAVAPVLPAAAAVSTSPLHRMASVPVSGLSTLPVETRALRKASGDSARPSKQSSCLGRDGHVEAASEVGARRPQPANGLSEPTGKDGRNAPEPLRGNSGGTPEGGEREGSGIGEGNASGDADGPARKGFWYRSVSTNEDCDETQWESRNALSDPGDHMLNTLDKLAKVQDKLDFLQQQVQQQTKELQTYYNSYKTAEEIKDALETSMADCTVCFSRRSAQLGEVEKRLKVLTAESLTGCSTAELEELAQELETTLYKMTAVQTQRAAGVAEYCAEEPPRQLLPFSSDCLPEPKTTFIIPEEPAAMVAVDDCVTLGEEIDTEMEDILKDLRQAQKMHEAFRKEYKRIQMKVEQEVNVFDVDLRKLTSVERTLEERLRRLLCLTGDTDYADVSENALQECFRTVNYAVRRVYRHLALKEAGHPPPCPSGSTGHAESKKSCTQQHSQPRDTRTSSSGAPQRPATQEDSEDPHAQSAFPIVPYSPIGRTSPSLHRGRGRDTGEAPQQRRGPLALRDSSASLEHPPAPTGEQPRLGQASAPWRQGLQNYRLVVTPHSGVSGSAALSAPSSTQQDYGALHPHSFSRGRVSGRLPWRQGQSPDRARRTSRDDYIAGATTPLRTAAAKADAGREASLKAKRLARGEETDEEGFAIEDGQYTSSVSGSDREGREDFQQLRQTGALSSGPFVPSPRDADRQLVPRKTVPYGASIRPSVFHTQEDLAVFREERENARQLRYSLARSREAPSTRGRLESTESVISARSYPGSLAADATHTLAKMPFACPGTGNLLRLSPSLKPGTQRISHGSHITSPPQSVSLSPLSTEPAERGTRAGTADRQQESLEPELEGQARLYQLQEVRERARAPDEKAREEVERIQSTCERDRRDGGREGDGSSSRRRRLLATASAGALPSPPSSLGRGVVAGDDVSRAAQAQLTGRVAKPLEDTVDGERQQIASGGRRRTTVEEGTASRELVRSRQFSSPALPEGTREATAPHEAGEAKPDLSEPRSARGSAVTLERGFSVKLLRDGSIGSEGSVYLPASLVEGASRRGTVESTLSETLPEKEDALLLHQKAAVMLRQGAGRRATTGELDRPTSIVPHNSLRSSDAGDSPGLQLARPGDDPRNASGKRPKRLSAALEALGQSEQLPVLRQLAAKSSSVSEGRPTLAHTGNGESGRNSTDGQDRAIWSPGSTLARVERRVVPSKAVGAGVRRPAIATSSVSALPAPEAGTDERGLNLLVRSDELAVATTRSEEANADTAIATGTEGERAKERRRNNHELAMLGKNAVSAGSRRVTQEQARSGLAAPTHVEYPPSEMNSGDSSGDEMSDTGNASGRSHRVKHRDREDSRATGMDEAERRGRIGSLPDENSNEVFVSAASWVPPEDDGSERSEEM

SEQ ID NO: 434 - protein, 113 aa, Neospora caninum
MPTKRRNGGRAKHGRGHSAVVRCSNCGRACPKDKAIKRFNVRNIVDASSQRDLREASVYNTYTLPKLYIKQCYCVSCAIHSRVVRVRSVEQRKVRENPQRRPQGQQGGQGGNN

SEQ ID NO: 435 - protein, 181 aa, Neospora caninum
MLEFKPAYEYSMPVASDSSSAHVNSRAADACHATCMSSQRQSGFLENRMAKAHMRAAGSGRGAGGKKGAAAKPVKVKFTVDCQKPVDDNIIEAKGLERFLQTHIKVDGKCNNLGDRVQVSREKAKVFVTAELPFSKRYIKYLTKKYLKKQMLRDFMRVVSSRDTVYELRYFQMPQEDETAA

SEQ ID NO: 436 - protein, 336 aa, Neospora caninum
MSNWSSLVVTVSFHAFVQASFVKMVASRLSCMLASGAASRNLVPKSLSLGWYPSAKKSFSSLSVLSSASSASSSSSLSSLLCSSSLSPRALAGTQSASACTAKRTYLHFGRTMPEDFELPSDTMPKNVAELMSKNPKDLDFFENYWYWKLRGEAVILDPATLPQKSYKQLARDMGMQIVTEETEHMVGLLELYEHLRAAAFVGPFGTIEKPVLCPSVTTDRIVGCTGGTGEKEHVPLWFRCREGFLYRCGECDQIFMLVRVFYSLPDGKDPFPVDPDVEDVFDIKLLEKGQKMWNCNEYVRWPAGHQAYSELFLEGKWGNEIPRRLAQEMREIEAA

SEQ ID NO: 437 - protein, 248 aa, Neospora caninum
MEKYRKVPKDKEPIGSNEIRITSAGKVMNYVAYAARLLTEQNMRKITIKATGNAIARAVTLAEVLKRRFKGLHQITKCGSTTITDVYEPTEEGLDKVKEDRVVSFLEITLSFDLLDQKDPGYQAPIDESLVKEMKPEEITKTGGFRERGGFRGGYRGGYRGGYSRGAYRGGGDFRGGYNRGGFRGRGGYRGGRGGDYEGEYRNGDYGAEYNNGEFGNDYSGGYRGRGRGRGFRGGAVGSYRGGRGRPE

SEQ ID NO: 438 - protein, 242 aa, Neospora caninum
MDPKVESQTNVPSGAEAEQPKAGEAQATVENGNTSAPDAQVKSQASSEDVVAQSSEDFSGKLQANSGIVSFGDSAAGSGAFNSMDVQNFLQRYATSKMFGVPPHFFQSRESLRVWGADHLTDPMVQPYEKDDQNLPNPFHVSLPGYSPSLCKYVLTKGEKPPRDPLLGPEITIYPPTWIPHWEPDPNFKPQAYNFNWEENGTFQMERLPYAKAVFDPADGSAHGMYKQAYPYTAYPYGVPRV

SEQ ID NO: 439 - protein, 299 aa, Neospora caninum
MLGASRAFSPRDALPFFFFDGHAGRFVEAAMVFVALFGVNAEKEPIPVLPTVHYNMGGIPTNWRAQVLTTSRSKSGGPDKIVRGLYAAGEAACASVHGANRLGANSLLDIVVFGREAARTIAEECKKDTSAPSLPPNAGDETLAMVDRVRHANGPLSTAQIRQRMQKTMQDHAAVFRTGPVLKEGVEMMKDVAKSFADVGVKDRSLSWNTDLIETLELQNLLTQAVQTIVGAEARKESRGAHAREDFKERDDQNWMKHTLSWQTHRDVAQAEFPLTYRQVISQPLDNEMEHIPPAKRVY

SEQ ID NO: 440 - protein, 385 aa, Neospora caninum
MGCTGSKAAVAKKPESLEEKENARQQVPKSQSGTLAGAAPVEATQDRRGEGKNAASRSTSRAGEATEVRTAASTEVKGPPAQGGQIDINEDPLAGIVLEPPEDCEPVMMKNGVVYRGEWKNGKQHGQGQQKQADGVVYIGQFYDGHIEGFGRLVRPDGSKYEGEFAQGKAHTKTRNGKYTFADGSVYVGQWIADKRHGIGREVTHDGSVYEGEYRNGCKHGHGRMQSPSGDVYEGEFSKGDMNGKGRYCWPDGRIYEGEWSMSRMHGKGVFFFVDGRKYEGEFKDSKMEGEGRLTWPDGSAYQGGFKGGLPHGRGTHQATAETKPRLALWNQGVRVKWLNDEEMQQEGEHGKQGSEGPSKPSPAQGDRSTKPQEQANEKEKVSGE

SEQ ID NO: 441 - protein, 239 aa, Neospora caninum
MRTFSFLDFLRFLDCYRAFASAGSIRESLSNVSLVWSYPSLERRPLSWASHRTILLNFGKMNAAHLRAIFGNWCTRGTDHIVVDMYAKKFYKAYFADPVQYNYLFVSFFAVGCAATMCLRHVMLNPDICVRRGDARRHFIDRWQHHLYSLPYYNHYLRNFALRFQNSFVDNEPDYLGSHPWGVRPTRCLNYGRVPFTFMNPYQYFVDDPQYVSTLHGSMEKHYEALGYYPSRAKNTEEE

SEQ ID NO: 442 - protein, 483 aa, Neospora caninum
MAKRDASSLLSLAFAIALCGVSLPVSFDWAVGHQLSPPSIGSPVFPASRAASQPTNHLPLAFVKPAPRHVLNFPSSSISPSSPASPSSPSSPSAPSSGSPASLSTSASVSQMDRLSAGSPLEAASSQRLPVQIQEAVVDGEFVNGKSVKDWKVERSLYQALHMALAEELARDPNVCVMGEDVGHYGGSYKVTKDFHARFGNFRCMDTPICENTFTGMAIGAAMNGLRPVVEGMNMGFLLLAFNQIANNAGMVRYTSGGAFDVPVVIRGPGGVGKQLGPEHSQRIEAYLMAVPGLKIVACSTPYNARGLLKSAIREDNPVVFFEHVLTYNIKEEIPLLPYTLPLDKAEIAREGSDITVLAYGKLRHVALEAAQQLEKLGLSAEVVDLISLKPLDMETIRASVKKTGRCIILDESSRTGGIGGEIFTQVMENCADDLLEVPIRLATKDIPTPYAAKLEEATIVTPQDVVNSALWLASKRGLPKQA

SEQ ID NO: 443 - protein, 835 aa, Neospora caninum
MATHVGHSAGLPAPASWCRSACSSGRRRSAKRAFLVFSLLALSAVLTPILFPTIAHSRPSFVNADPGAGSVDPGQESESSASEDASKLTSAGAAHIPGAKAGENAAGALSTARGEGVKDREGLLLWNGEQAAPAEIKSRLLSMRNHAGSLTDKFMEKIAQLTAQIDLLRMEVNKAKGEIQHLNESFDGKTEETLRMIDSRSADFIRGLSRVEEQLDAQLRPPNGAVYKHLQELRDQLTQIRAQAESSFNTEASSVMRQIDTCSAKVDELTRVYFDMRHRMDVEVNDIDARMIAARRELDDLVHERLTALGEAEQRITADAITRLRDFLQNLHLEENMLQDMVQSIQRDFLEPSSFTGSRTHREKGATYIDLSSSFASSKIEKVCGVMTHLVKQLLPGKTVIPIFIHTVPQVSTTNLPNREKGVKLFGGLGGARALFNSLNLGPSGWGGGEEEKKEEKAHSEAPIIEMVLPDEHMIAAVAVGWLRERQRTGPLFDHYAVVRVDGLLAESYTVPFLQYLQFDYTQENRFALARTDQFAEKLETTIHEKLSLLAEALEKNTYLLIAYLGEATGDVKPQPSLVQTKNRISTARRLLKNLKAPSLGAYFWFEQFKHQLQFIDEVTKAFARNQKKRLANKVVLQGDDFEIVVVVGRKGTGGEMLKISMPPCRQGDPFFLPAFTILSMNLTALTPELVAFPSDGLLARTLQVLLSDVRGGAANDEESAEKSQQRAPTCGATISTNGVTKRMWRPQVLKVSLSYMEKIAESPRGGAAKNNRSPALKHVPVVQDSTQDAIGANLPKGYEDLAQYIIAAISRVLRDRLEVLPRGFTLYVVANVKE

SEQ ID NO: 444 - protein, 1499 aa, Neospora caninum
MPPKKAAEGGGAKKKVERKYSAVELGDYLLGSPVFVREPSKEEMYVKAIVKSISGTQLTVDIDGNTKTVEVAECLNANVGIDPVTVVDLAKLPHANEACALEVMRERYVRDQIYTYAGRLLVAMNPFKLIPGLYEPATVTKYQNADTSRGFPTDVPPHTYAVAQTAMDMLKMTKENQSCVVSGESGAGKTETARQLMQYFATSKSGTGGDKIQEIILGANPLLEAIGNAKTLRNNNSSRFGRFVSLDVAPTGGIHGGIVSNYMLELSRIEFQGQGERSYHIFYQMIKGLQPDEKQKCALKEAPQYEFLNKSGCYEVETVNDLKEFAEVRQQLKLLFSPEEELDYFKCLSAVILAGNIKYKNTQAMGTDKAGKVVNDDDFQMIASLLGADAAALNEAVTINIVEVQGNVIKSPLSADQATVMIRSMAKELYNTLFDYIVKSVNKQIQFDAESKPWIGILDIYGFEFFQKNSYEQYLINYANERLQQFFIQQVFQAEKVEYEAEGIDHSMIVYSDNATVLEVFDKPKAGIFAYLEEQCLIQTGSSESFTAACHKNIKNPCFQIPKGDARLSFLIVHTAAPVTYDTTEFVPKNKMRLPNELLVVFKSAKNLCMKNAFADIEIPDTKNMRGKFVGSKFQKSMTGLMTTLKSSHAHFGRCIKPNQVKKPQVFETETTLGQMISLSVLEAVAIIHKGFAYRASFQDFVQDNNVLMSVLGAKVEGSDMKQACITMLDRLAIPKEEYQLGNTKIFLRKTGWLMIDKHFRTVMANLKPLILKLQSIYRAYKARVLYTSFSRRVVRIQALMRRYELRKSALQKKIGCRIFAGSIFLGMFCQSQKELRQVKARMLMKKAAAIGYAGIGGIRWKQFMISHRMIRAAVKIQSHWRRHAAQKLAKKLSYEKMRNNAATDIQRVWRGYLGRLRVQLMRLLTPYAITIQRFWRGYRTRSSAMYRTHAKIFDGIRRGFLEDQGRVVIQSCMRRYIVLSRLQNVTQAAYSMQKFAQAKLLRMYVSNVHAATLTIQAWWRGNRVRRILQEEKLKLVLAGHLMRAEKQTLQECQQAVVLLRDRERCGKRLKSWQLIHVNVSVERDDVYPKGWATGIRTVESFNPAADLSHIELGAFHTVVATSSGYVYTYGLNDRGQLSVGASSVSGLPLPMQPITGLLFPIKIKQVSCGVDHTLLLDGDGRVFAWGSNQYGQCGCAPRQEVVPEASEVHFASTRGASTPMARRAITMLSAGAYHNAAIDDKGRVYMWGRGDHIYIRGVFSDVPLPLWITHDSIVDIGPLDSVECGLGFTYLLAKDGTVYVFGQAINGQLGLGSKHRRSRVAVPIENIEERVTSISCGVHTTLAVTPSGTVYQWGVFLLWDTNSQVCVKAQSFVPMSVDLRRGGITGVAIDVKVGWWEGVVLTSDGLLWAWNFFDQPSEDVLRPAVYQYVLTEGQIVRAVHVVSSPLFSAVFSKLEEDKAAEKMRGSAAAPSAVRTRPSVNPHWDPLAYNKVSTMHLFR

SEQ ID NO: 445 - protein, 190 aa, Neospora caninum
MASARLACFFGAVLLCLAPSCWRTALAEDHYFVFSACKISFGRIRATVHPGDTVTMQCPGAISSNPADVSKYACPGEDPNCTETTRASYQTLFPKAPADFEFWSGSDSMESLGVLHIPPETDEITISYSWQAALSRSTGHAAESRLILDIEKSEEEVVRTRIPSGGALPGCELPSLLALFLAVVSAIAMH

SEQ ID NO: 446 - protein, 118 aa, Neospora caninum
MASGMGVDENCVSLFNELKIRKTVKWIIFKIDSTKIVVEKDGKGNADEFKAGLPANDCRFGVYDCGNKIQFVLWCPDNAPVKPRMTYASSKDALLKKLDGATAVALEAHEMSDLASLA

SEQ ID NO: 447 - protein, 150 aa, Neospora caninum
MADAGDAAANQPKRRTFRTFSYRGIELDKLLDMKMEDLLELFRARQRRKFQRGIKRKATTLMKKLRISKKNCAYGEKPEPVNTHLRDLVVVPEMIGSVVGVYNGKQFINVEIKPEMVGYYLGEFSISYKPVRHGKPGIGATHSSRFIPLK

SEQ ID NO: 448 - protein, 135 aa, Neospora caninum
MADTGAFSLRFRKLKTNPLLQRKQFGVDILHPSRGSVSKKELVEKIAKQFRVSDPQSIVVFGLKTAFGGGRSSGFAMIYDNPNAAKKFENRFRLVRLGYVEAKASKGRRAYKELKNRKKKVRGKEKAKCSGGAKK

SEQ ID NO: 449 - protein, 154 aa, Neospora caninum
MQIFVLSVGGDTLALEVAPTSTIRDVKEQLQARQGIEADDQRLCYGLHALEDDETLGELGVEEESTLYQSLELLGAGKKRKKKTYTKPKKQKHKKKKVKLAVLKFYKVDGNDKVTRLRKECPRETCGAGVFMAAHKNRTYCGRCGLTYILNAEE

SEQ ID NO: 450 - protein, 172 aa, Neospora caninum
MANPRVFFDIAIGGRPAGRVEFELFKSIVPRTVENFRALCTGEKGVGVSGKPLCYKNSTFHRIIPSFMCQGGDFTRFNGTGGESIYGRTFADENFKLKHTEPFLLSMANAGPNTNGSQFFITTVPCPWLDGKHTVFGKVTSGQNVIKMMEGQGTQSGSVKQSVVITDCGETK

SEQ ID NO: 451 - protein, 134 aa, Neospora caninum
MAPRLVYRRHNHYATGSNRVRRVRTPGAKVVFHNVGKQPSRPKCGNCHRALPGIPAVAPHRLRLLKKRERTVHRAYGGSRCHACVRERIVRAFLVEEQKCVKQVLQVKEKQKKDELKAESKKSKQKKSSKTAKA

SEQ ID NO: 452 - protein, 188 aa, Neospora caninum
MAGGIRRQHPAPAEKKDDSQKKRSPNRLIVEEAINDDNSVVALNPAKMEELQIFRGDTVLLKGKMRHDTVCVVLADQDLDEGKIRLNKVVRKNLRVKLGDMVHVSACPDCPYGKRIHVLPLDDTIEGITGNLFDIYLKPYFMEAYRPVRKGDLFLVRGGFRPVEFKASSHFCGNTVPRMFCSLPRDMC

SEQ ID NO: 453 - protein, 400 aa, Neospora caninum
MVGFRRITLAAVVAGELAWVGPAETMAFTVPSASGAMPVTPQSARPSWSAARPNAFRSTAHSQSAVRPHSAFVTHAMETADATGTQHRAAGSAGEGTAQSAFAIDLTGKTAFVAGVADSQGYGWAIAKHLASAGARVALGTWPPVLGLFQKSLQSGRLDEDRKLPDGSLLEFAGVYALDAAFDKPEDVPQDVTKPLLETSRKGYLAASSNSAYSFVSLLQHFGPIMNEGGSAVTLSYLAAERVVPGKFLDPQKSILRESSQFQHCEYWSSALIPVGYGGGMSSAKAALESDTRTLAWEAGQKYGVRVNAISAGPLKSRAASAIGKSGEKTFIDYAIDYSYNNAPLRRDLYSDDVGGAALFLLSPLARAVSGVTLYVDNGLHAMGQAVDSRSMPPLQRPAE

SEQ ID NO: 454 - protein, 197 aa, Neospora caninum
MSKNSCGSSCSPGRECECGLTRLLSWENPTTTGSLFLGFNLVYFFVFVLRKSLLSVSCYFLLVPFAAGFLFRILDLAPSFGEGPAEIVSRSTIGEKINGCYEKVNHVLESVRDVLLWKNAMYSAKCCALTWAIGYVSSFFSMSFLVFCVVWIAFGLSFVKKTCATPVCSYVSPYIREAQDLTHRVVAAIPRMDNVTK

SEQ ID NO: 455 - protein, 482 aa, Neospora caninum
MEARSRDQEHSYPPVYRFCRFLRGAPLTTAERGSGSPLFRSLHPAALTCAVASCAEKEEKSFLSSFPSFGLFDKKDPKDDGTKSSSTSSFSPDASTSARQASPGDTGAVGGPSSEPGTLPTGQLSPGGSAVGSSSEAGESASNPFLQPRSKESDTSRPPIPVPYEQFSREWMAVAGQDNFDGFRLEATKQVNKVLTANHTFMLGTQTKEGGCSYSFGPTLVIGEPDEAAQQEGQMPSFFGMARMNSDGFLQARFIKAITKTFDVKFNSNSSLNEESKDKSMYEISFDKMGSDWAANLKLAWQGTWILNGLFSQVITPKLQLGGELTWVAATGISMGSFGARYGFDENNVVTCQVGVGPDFSSPMGFASDVYSTKTQYVRKMSVLLTGAPWGFQVTDRLSMGTELEFTHPDMSSAMRVGWQYLFRQARVQGLVDTAGRVSMFAQDYNGFGLSGMIDYWHGDYKFGFQMNVVPPPPQVEQPPPM

SEQ ID NO: 456 - protein, 463 aa, Neospora caninum
MFTLRNQPEDARALFRLFLADKEGMELWKANFIRHVRHSMRRFVQAAVSAGEKPFLPDGDAGEDGSNADDIEAALQLHAEDNFWESRPASSMAAVQLIKEKMAKRAETGDAKHMWEPEVSLRFKFLSLKDAKKLMGTFLVNTRVEGLRLPSGVPLPAKTVFENANEPVPANFDARTAFPVCKDVVGHVRDQGDCGSCWAFASTEAFNDRLCIRSQGKGVMPLSTQHTTSCCNAIHCASFGCNGGQPGMAWRWFERKGVVTGGDFDTLGKGTTCWPYEIPFCAHHAKAPFPNCDTDVRPRKTPKCRKDCEEAAYSEHVLPFDKDVHKASSSYSLRSRDAVKRDMMAHGTVTGAFMVYEDFLNYKSGVYKHVYGGPLGGHAIKIIGWGTEDGEEYWHAVNSWNTYWGDSGHFKIEMGQCGVDNEMVAGEAAWQETEGVVNGDKHPGVEPAAEARPGSRARVEREM

SEQ ID NO: 457 - protein, 614 aa, Neospora caninum
MSQFRDTFTKEEQSEPLLDYDDSAFMFYLCTVSFCTVLPWTFFSLKKVLYPSSYAKQYPEKTRKGSVYIHCKCSECMSKRERESARAGKWSQRWFGGYAWIEKLALVLAWIALLYLCVNLPEMKNLKTFDPFEILQVEPSATNREIKKAYRLMSLKYHPDKNVNDPTSAAKFILVAKAYQALTDPVAKANYEKYGNPDGAGNMKVGMGLPRFLVEEKYQLLVLSCFFLFLLVLLPMVFICYYQRQKKYAPNGVLVETLQFLTHYMAEGSRLKNFPEYLSASGESRAMQVEKEDDVEMRELIDQAIEPKKRALNTPIIVRNYYLILGHMQRLHHLMSDRLRGALDELLKGKHAARELGDFLKQDPEERKGMVDMNADQQLDIQAFCHQVSRMKMEATVFVEDEAEIVAGDFATCHVTLTRTNLKEGEAAGAVHAPLIPMAKYEEWWIFLVDKTENASTGGRILNFVRSKSAERVVEERIQFRVNRVGKQSVTVLAICDSYAGCDCALELEFKAYHPEEKPRPVWIHPEDLRLDEEPTLFQQMLGEMYTSSDEEESFDLDEGQRVAVKKKTQEASETPGTSAEGNSQATAQGASSTAPSEKNEPAGSQAEDKTGAA

SEQ ID NO: 458 - protein, 584 aa, Neospora caninum
MFFPSVGGSSTGGAAPNMASPKLNLPGKDDDITGKFDPTALERGAKALKELDSSPNAAKAFEVTKLQEQTKQKQLQKEMEELATVRMRAQADHARAEAEERRKTINHAQEQERVTAQYRAQLEAEAYQKKLQDQQKQNEVWLEQQHQQFLRQQELRKRQEQELLEMRRQQMREEKALEREVMRERIQEETKGRIKQERENVDIHLREMRAKAAEFRKTRMETLQTVFSGVGNAFNELMSDRSRLATLVGSLTMLACGVYGARTGAHLVGKYWESRLGKPPLVRETSRWVFSKSFFNPLRFIRGKQKKDFQEKIVLEEELAERLQWTTNSLISSKANGTPFRHMLLYGAPGTGKTLFARTLARESGMDYAIMTGGDVSPLGIDAPNEINKLFSWANKSRRGLLLFIDEADAFLRQGRGTASGMSEDMRNALSAFLHHTGTENDKFCVILATNCREILDQAVLDRVDEQFEFPLPAVEERKRMLKQFLDEYIYCTTRTGKKIAVDEKIDDAFVQEMAEKTEGFSGRQLAKLAIAFQAAVFGSGTNTLTRGMAETVLAWKLAHFDQDIDTIERRARDQKLSDARAEA

SEQ ID NO: 459 - protein, 223 aa, Neospora caninum
MKKRQGKVVDTATPPPQGDEIKKENKLACFLRTCNAAMPTCVQQLIQAVGDELRSVYRRPREALLSVVNLLCVLFTALMLWRVLVVFSNSPSPVVVVLSGSMEPALQRGDILFLVDRGPELKAGDIVVFKVDGREIPIVHRVLSLHENKEGEMAMLTKGDNNSVDDRGLYAEKQLWLNRTNVVGSTVTFLPYAGMVTIVLNDYPVVKWCAIGGMLLLAFLGYE

SEQ ID NO: 460 - protein, 337 aa, Neospora caninum
MQESDGGATFGGFLPPQAQPSLLLSVLAGLTVAVCAVHWIFAKNRGSGKPFALWRSAQAATPFLDKTRKKTELVDKIVVSPNTFKFRFRLDFPEQVLGLPVGKHLKLFAPTPKGTAPGQWNKAPDAEAEQAEIERKYTPITGDDVKGYVDLLVKIYRKGEVAQFPDGGKMSQYLDSLRIGDHVDMMGPFGLIEYLGDGEFRVNRRVLKKKHIGMVAGGTGITPMFQLLSSILRAGGDSTSLSLLFANRTEDDILLRDELEEMHEQYPDKFQCSFTVDVPSPTWRFYSGFVNEEMLKAVMPPPCSDTVILLCGAPPMVRSCSQQLSKLGYAKEDVLEF

SEQ ID NO: 461 - protein, 579 aa, Neospora caninum
MASPESNAVNVAAAAQKPACPPSRRFHVCAVGEEANCDCLARLSGLARVQFWLSKLLPRDDLPGANQKTPFSLNRYLLLLLYSIVVFTTGAVFYGWTALSAMIFKNDGFAYLCAKNSEGVYEPDLRESGKLYICDEQDATVQKLYTMTFAVACLMSAGAGTLLDWLGPLFTELLGQVFNLIGWLLLAFSTADYPLYYPALVFIGLGADSSMLPTLCIRRLFPGSTGLIITILGSAASASFGIPLILSEIVENHGFSVRTVSIGYCILGPVLGIVVAVLFMPRRGFALDDEGTIFREEDEAATEAPRALENGQADAQSSRDVGHSLRAVTKSSFWSQLFSVRYFLIVLYFVVVSWATSYYQQAARRMFSDSVVSVMEILLPLSFVPCIILGKIADVVGIIRVLVVMNTSGLLTYVFSFFKNDATGYLSAICFMIYMSLLTSQVYVYVEGTFSPNHFGKLIGLSNLTGGLLSLVSNPLYENITVNRDNGDPLCIQIAMTVLLCVQYLWIFILGFLKVRDARILHLELSDKNPAGGAAALSPEKAASLPATEQGDDSRPQKALSGARETELTSVNVTTPGSS

SEQ ID NO: 462 - protein, 510 aa, Neospora caninum
MATAARRPPGLCTPFLLPWNAPQGRRSARPARRLLIVVTFLVSTFTWASSRSSLVILSSAEPNSPSAEPSKQTPSNVGAEQPSGGEISADKSPGHLRTESNKSDAPPVRCAQSLRDAVNGAISEISGELKLKASSMRASRRFSAEHQNVCTLVLFSGTRVLVEHLLRLWNAVPYVPMLVCPSSMFPYAPTLPWPRQENLRDGDVLRDVLSTGTLTVAGVGSAAVSQSSLTVVAARNRGEEGNYNRPEPTGFFPQYMRLIAATIGAHYDSPISVHWLFYPSVEEAQRAVLNGQAHMTDIYFLLGQSTPGEPQPLMDFYATCPVVGSPALLILRDESHDDHQSTTATKQPGSVKANTLSKNELLNLNRRIENAEEDWERTVVFVSQDLANTVQHSLSPKAMLYFTKNLESALKMVNDWEAAAVMTTGIIPPLPPSLKVVDAHLLLAKGAWIERTNALECMEDEHDNLVMKYAEKRASDGSGGLEFARSSAVSVIAVSWIYVGAALSSAFTYW

SEQ ID NO: 463 - protein, 920 aa, Neospora caninum
MAPFSPVLAPVSLFLAVVSSALALQLTPPSSSPLASSAPLPGAPTLGFVSSPVSSPSLVLPASRPPFSHASSPATSAAAASTGQAINAVASFHRGERRCGRDSAQAFCAFGAGRKQQTVLGAKLLGSVQEIAMPALSSTMKEGRIVTWSKQVGDRVEPGDVLMVVESDKADMDVEAFDSGFVAAHLVREGEAAPVGATVALLAEKEEDIPLIQENGLSLLPSPASAPPSSASSQAVTELLMPSLSASLTTAHVAVWRKKEGDPVNKGEVLFVVESDKADMDVDAPHDGVLAHIAVREGVKVPVGSAVGYLAPSAAAAAAFKNAGLFSSAAAAENPSTMPEGALEIFMPALSSTMTSGKVSKWNKAVGDVVHVGDTLMVVESDKADMDVESFDEGYLAAITVAEGESAPVGQTVAIIVPSKDDIPKVQDALEAAASASSLSTHTAVAAAPSSTTPSPASSAASSSVPVSPPKAASARGGGRTEAFATHDAALAGWTSPSVDQDVKDQLPAGLTGNDLQQEWMQRIQATLPTAFSVLKENPQIQKALTERLNLRVPPPHTLRVAPSPPPYLRRAASAFGPGTSGPADTQGSGVERKARGAARDPSGQPLATFNAVELAKKNKLNLEEVKGTGTNRRITVADVRHHLHLHSDEAAVVTSSRGEKEGKSESSGVPAGSVPLDAMQKAIARNMEATMDVPVFRVSRGIFVDKLEAMMQELKQIVAEQNAAAIAAEGPDAPQQPPVTMSVLLAKAVALTLEKHPIMNAAYNPTDGGHIQHPGAVNVAMAVSIDGGLLTPVLRDANRKSVFELSADWAALVDKARKRRLTAEENSAGTFYISNLGMFGVSQFDAVLPKGVGTIMAVGGTESVPFFPKTGADSSGLSVRRRMTVTLTADHRHIYGSHAAAFLKDFASLLETHPSALLI

SEQ ID NO: 464 - protein, 564 aa, Neospora caninum
MAKVPAPPTVVKTDPTAIPFVGCQPAKKVQMEAVDIKEAEKYTGDLAVFSVLAPGCFHDDPNASQPQKGPVALPEIAQNFDDAVGQGMLKDAADASDFKAKMGSHVFVRLPSKSSPAVKSLAALGFGSLAELTPPSVAKAASALAGMLLRGAGEKAKNVALVLPSCPKGGCPSPEGQKKTQEMKERVVTSFLETLLVELQPDLRFKGDRDGGKDSGPQLEKLTLFTDDVEAVNRSIARAKIVAPGVYFAQELVNAPANYCNPVTLAQAAVDMAKEAGLEAEVLQRDEIEKLNMGCYLAVAKGSLFPPQFIHLTYKSSNPKRKVALVGKGICFDAGGYNLKTGGAQIELMKFDMGGAAAVLGAARALGELKPENVEIHFLVAACENMISDKSYRPGDVITASNGKTVEIGNTDAEGRLTLADALIYAEKTVKADTIVDVATLTGAVIIALGYKYAGLWSNRECMASSILKSAENSGEYMWHMPLAKDYAEALDSKCADMNNVGGKGKGGSIIAAVFLNKFVEKACWAHIDIAGTAWDTKTNRATGFGVRTLVEYIMDISEKTKEN

SEQ ID NO: 465 - protein, 392 aa, Neospora caninum
MKLLTPKDDVRGRKVQLVAAFLDVPLQTVPFTVGKDDKDPAFLAKSPLGRLPLLESEVGGVCLFESNAICRFLARLRADKCLYGETLAEQGEVDMWLDFSTLEVEIPMCCLVQGGKVAERAQSDLSQALNAVNAHLKTRTFMVGENITIADLCLVTVLSYGFRSGKVDCAAILGQRPFLKRYYETLVNQKSFKKVFGEAKSATPEATSAKKETSAKPAPSAADDEPAKKPAVKCELDLLPEPSMDLNEWKRVYSNTKDLYGAAMKWFWEHLDTAGYSLWYMKYQKLEGECTVAFVTSNQLGGFMQRIDPAFRKYSFGVIDVMGENGCFDIEGVWLFRGQDVPSLMKEHPSYEYHTWQKLDHASEKDKQLVADFWCACDDIQGRPIADSKVWK

SEQ ID NO: 466 - protein, 298 aa, Neospora caninum
MRISLKKRNGKFIDAFELPDDCTVEEFKELFYQKFHYYPERQWWTVDTAKGVPIKGNGPLEAYGVQDGTTLVFKDLGVQISWRLVFVLEYAGPLFIFPLFYCCSALIYGVDVPPEKCLVQKVAFWLTMLHYVKRELETLFVHRFSSSTMPIRNVPINCSHYWLLFGVFVGYFLFHPKYKPMWGDDQPVVIYGLAAAMVGFELLNFKTHLILRGLRARGTRQRGVPCGWGFDLVSCANYFWETLVWVTFSILVSCLTSWIFTVVGFLKMTEWALKKQRNYRSEFKDYPRNRRAIIPFIL

SEQ ID NO: 467 - protein, 556 aa, Neospora caninum
MGSRPFFLRASAALLEVLACCSWFSVSPAVSFSSPPSRGLVLDSLATVGPSPIASSLLVQNRASSPSRLFSQLGSRRSNLRGPENDFASSAAFLVSTAGARDNLSTPDLTRRLQNSASAFKPRSQSSPQSRLRATPAASQGGLRKKRLDSLSPSELRGKRVLVRADLNVPLEVKQEGAEEVVSIANDARIRASLPTLRYLVDSGAKTIVCSHLGRPKTEQDRQRLSLKPVAERLQSLLGNARVFMAPAVVGPEVEAMAEKLEKGDILLLENVRFEKGETKNDEELSRAFAKLSDMYVNDAFGTAHRAHASTAGVTKFLRPSVAGFLLHQELEYLSTVVANPVRPFAALVGGAKVSSKLGVLRALIQQVDKLVIGGAMAFTFLKARGIKVGASLVEDDQLEAALQMEALAKEKGVELIIPDDVVVADRCAPDAQTAVVPVTEIPDGWLGLDNGPQTTARIVQSLQDCKTVLWNGPMGMSEYEPFAAGTQDVAKALAEITRRGATTVVGGGDSVAAIERLGLSREFSHVSTGGGASLELLEGKLLPGVAALSDEEETN

SEQ ID NO: 468 - protein, 692 aa, Neospora caninum
MCDARASPGGPRLLVPFTSTIRLLLALLLLASVSPVSAFRSLLPPLNSNTTGKSSSVVAAPPTLFLSGRDSASCACQRAPAAAASASSHSTRDGEFLLPSILTGGNDAETGALDGKTDAETAAFAPRAYCCADKEEALSRSFEAPNGVAFASIGDIGEANRDQAKCAQTLAALSLALDMKFVNLLGDNVYPHGVVSAYDPLWEEVFEVPFGAPSLEKVAFFPVLGNHDYHLDPYAQIDRCMRLEAAHARSAVPEAKTGDAKAPLEGASATQAILPWAQYVPQKFRFVFNQTARMRGIDGPRWRFPNFWYFTRHVFRNVPRHLSNPFVTGSSISDISLHSSGDDKTDVTVVTVYIDSMVFLLEEGSTSTSVPYKFPRDEVYFRQLDFLENTLKAASQEADWIFIAGHHPVVSDGLSRQGVSTFKTRLLELIAKYKVDTYLSGHEHLLAFFEDPEAKSTYIVSGSGSKRASKGSCSADKCLFAGHEHGFVAHVLGKEELHHAAVSAEGTILFTHTQRRQDRTVPNPKKAKQKGAVYPAIRRVYIGPYEISAVDDLQRLPSYVYFLLGMCAMGCLLVLVFCIRRCVVPFYTRSRRAPFTTCKKRCRSSSECSWFAGDRPRGDHAPPASRRSLPVPLRLVSQRSGEGQPLVYIHGAGLDGDKTQDPGGEGSGGEEKHDPWSSTRQPSDRETAVASQ

SEQ ID NO: 469 - protein, 733 aa, Neospora caninum
MRRPGAPEGLSADSEEDERLPSGRTSLRSVGLDNRRDFFSQSPTLAAFAAPGSPVSLFRRTSFSYVSVPSVFVALCLGLLVACLSVPCAGQIVTYTNQSAPEPLHIAAEKGAFFLYGKNTKFYFPFISLFLSSSSDSPPAPTVTFKNVRLTAESSATVQKALEEGPTESSASPAFSARSPASLELALLPYAYVRTLFTSPTAAPFCCSAQAPSGEGEHPSFSIPTSFSPTNECPYPGALKRPITGDAIPLLSSSLGAEGGSTREPTSPRVPVAVRDAAVAGQYVCPLTLRDEGAETGERRIQMEIEESDIYFLVASNCGNFKGLTFEGEVAVRNAYGYLPGYEYPKIPFYFLFMLVYLVVCFVWGCLMYRQRANLITFHKFMLVVAVLGFLESLALFVYLYDYNMRGDRNKVLLVVSILVSVVKSIFSYMLVLLGAIGWSITVPVLEKKTVVRMQIIVVLYIILDTVRQVSDEFSNSHSLPLVLLLTCLIPISTLNGVLFYWIISSINNNIEMLQQQKQHEKLLIYRRLYAVLLLAIVLAIIDLLCQIYVASWDASDRWRDQWWLSDAIPHFLFLLVLAAMMAIWRPSQQSRRLAYFTELGDVDDLENHPAHTKNAADLHVWGEELDFHDHFSEEELEAGIPNFKLHSVGSMSDDGNLSDEDLQGDEEGFHTSTQLTPTSSQRLPTPTHSAGEGNKPQPQVVGRETLDDEVEMTTQDGASTNGRRLEHGQVGL

SEQ ID NO: 470 - protein, 626 aa, Neospora caninum
MGKLGAALLVGVAAYLTYSIYIMYSETQPPVYRPKRSDAGDEGPPPLSSNRYSPDLLLSYEFFLSPFTALPPLQNLLAAKNEERFFHVGSVKSRPYNWEGEERLREAEKKNWSFQERLRESLNFSGKEKSDLEVIIPEFLRNNVTLFVHVRTRDAKTGEELPLQAVQKLSSSVVPEHLKVLKRYLLEDPWGTKLEAATKELQVPPPPVESVPEYIQVGPVLEHRPLLTEALLRTFGLNSPVVDIKTQTYALPIHLNSMISPEDEHLPLVALPHERFVVLPEEQRRSAAATSLKITYKPTGYASWLFLLIMGQAMGSLQSMKFSAYDVNSVKMMMGSSSPWVLLLVYLISLLHLVFEILALYSDVKFWRGQENLAQNFSANGLLIEMALEVITILYVRDNGDSFLVQIFIVLRLLLNVWKLRKLVTFTISSTPPYFFKIRGAPSSPNVADGAEPTAETEEKKRNSSGEKKSQKAERAAVDYEELQRFENACMWYLCLLFLPMVLGVSLYQLIYVPQKGWWSWLVTSLATCGYTFGFVSMTPQLFRNYKLQSVTHMPWRVLGYQFTNTFIDDVFSCFIRMPKMHRMSVFRDDVVFVVFLVQRWLYRHNKQRDDEEASQRQEVEEKKTK

SEQ ID NO: 471 - protein, 1102 aa, Neospora caninum
MRVPIAPSSLSKATRRQLKANATAGPPVAVPSPAFSLPPTPASRALSSPLLFTPPGRLPSGGCLAYDSSTGPGCSVFGELRLRVLPSSCNGLLQRNRFFSVTPPPVYNGATQFREDEPARYPPQEVGYEASSYGVNPRAPYAAPGTAYDAAGAGTYGYAGAPAQTVPGYPPYGAQGYGAVAPGAPYGSAGTPGYYPPQGAPHFSEETGYWPEGQAGAQQAEGYWGDDQRHVPAQGYPGQVPGYAPAPGAYPPSTPYPMHGAPGGVGSPQMPQYPAAPGFPDQGQYSAPYAPAGAPGGYGGFGAAPAIQPSYYSPPHTQAPGGQATQGDESARFQERMMELLQRRLGHKAWLYESALKKGGPEALLRLANDPEVLLHARSIDFVYVLTRFHHAFRLNRLVTAGGAESGALGDRDQAETSAEDGKEERVVMTKESERILEELVKFINNIRIAFKRRDARSEVGVQPFRQTSAEKREGDDAQKIGKGYLLDRARVFHLLAALTLPECAAARAVSRSKLYQKVALPFCAIASEEASVMYDLDITRVRGGVVATMELLRLVGFTGRISHFQHLILEDVATGPDTASLAPTQGNEAAETGEGDADANAKTREELALRRVAVEKEDSQRIWEKLAQVYIAAMDQVRLEHLLPAFTGVSVLFEKDMITRATFLQTVSELGQRMVVPNAFGQNEARGGAAIQLLLEQCTNSMRCQQQNQRLGFSSLRALARIMRETRSDVVIRCLASLSLLRCLREENLGFFSSVLLKRHYRQDVAARQLSPRTLSALIFTHAMTSSRADIHAVELTKVLTSMMGTVERERVLSTEDKCKLAWAICALRLYSREESGGQWDEKVVARLLCRLMEQTKDTSGKLCCFFLEAARECRDVVDEMHPGQGFKDFFPAERLEKVVHDYDRFGYYAMKADVALLRRALLTAGAVVRVSADRQSSQEKASLSLGEAEDAKEAGEAETKQVPESESENAGDSLGAQGIAGSVWEEGALLDGYPVAFYCPERKIAADIDRPARLPPKYMKMRHMKNYLDEHGIRYVIYSEELRHHNEDTFSGFLNIIQNPEDPRSTLAAVPKQVREMWTKRSGAARGTSDAAESSPASEE

SEQ ID NO: 472 - protein, 108 aa, Neospora caninum
MAKKAKKSGSEGINSRLQLVMKSGKVNLGCKTAIHALRTGKAKLIIISNNCPALRKSEIEYYAMLSKCGVHHYHGDNNELGTACGKLFRVSCLAVTDPGDSDIIRSVE

SEQ ID NO: 473 - protein, 111 aa, Neospora caninum
MGFHFQQYIAMAGRAINPVQWTRTWKKMEGKSATEVYRSALDWTNNQFAQISRASQYRAWWWANPLGMGLVLYGTYKAWHMIYMVRKQKKTAQLVAAAYGQGGQWLNPVPR

SEQ ID NO: 474 - protein, 252 aa, Neospora caninum
MARRYDSRTTTFSPEGRLYQVEYALEAINNASSTLGILAQDGVVLAADKMVTSKLLDQGRTKEKIYKVDDHVMCAVAGLTADANILISQARLIGQRYLYAYDEPQPIEQLVLQICDVKQSYTQFGGLRPFGVSFLFAGWDRHYGFQLYHTDPSGNYSGWKATAIGVNSQSAQSILKQEWKEDLDVDAALLLAAKVLNKTMDTGAPSAEKLEIAIVRKDPADDSRLIQRVLTNEEVTALIKKAQELQAEEQTP

SEQ ID NO: 475 - protein, 230 aa, Neospora caninum
MSERTGTDGAKPKGTTGKPGGGPSKLNAQVQQLFARMQQEIEDEKPANVIFFIVDFLCKHYPEHLQGFATIWNADPDLEKERLGVVEFFRAQKLPTEIAAHFTNAGFDTLETLCTLTSESLDDIEKFNQVRWLPGHKVRLQQTFADIAGRVRTFTEDKENLARAMRASMYCHHSQLMSKPNLLPSHPVTVIQGASPSASPPCYFPPPTSTPVALPTATAHRSIPYSPVYQ

SEQ ID NO: 476 - protein, 128 aa, Neospora caninum
MSWAARLLRLSSPRLGLLNLCRGDKLGAAKEKVTLKQFFDSEYFWTKANVGPFFLFLFTSPFWYQGIKTMYASCRYRKLNEREIISDRYTWLHERMLEDEVERTLLQHVPAGGFDKTRPGLILGPSIL

SEQ ID NO: 477 - protein, 680 aa, Neospora caninum
MPPKVREGGMVTRRRLLRVTRVAVPQPFPFVQGVLKVCGVADSAGEESAPLASGEAGEEASADETDEISLGDEEDEDDDDDDDDDADENENVDLSSLFGSFGGGAGLGGGLDNLQGLSGLFDNLGSAGGSGDPNLGNLANLLPALGKIGNASGEEKEDFAELLNKAAAQQNSGTNQVSPDFVNQIFSMISKNNTALNDIMTEFMQDPYMDVKEIERPTIDPQVFANAPPDTAVSTNKDGEAAESSTAETPKTPAATGPPEIVLSKIKDFVKKPGDSEAEGAATADPFAETNEDGAVCRLLVLSGGGARSAFQAGAVVGLAEQYKAQGRELKWDVVAGVGFGGVQAAFGLPFKPGQNGELDYGQSLWRFWQGLKEEDFMRCENGMKDLMDIRATMKWIQKSQKYATNVAKMLKVPLPHSCDTARLAATLRSQISQLAKKEVSGDASDADEPRVAVLTASKLGGGRHSWTLRPSHLETDQCKTGDAGSVCTETQESPEDAAAAESRTPLMLALEGTTAIPGTFPPIPFKNATGKLEGLIDGAVNTFLNVLPGLSACQDRVRRSPKNPFSDEEIAGGKGVSVDFILSVEADKPNTEGTMTDEDSEADDLFDNTGVPLENIALLKEKFPALTIRHVLAPEESYELAHDLMDLRSIRALLELGRVAGWGAQLFEPVKEDSASDES

SEQ ID NO: 478 - protein, 241 aa, Neospora caninum
MIGAAGAQEDRAYSRPGQLGAGGHGDLGYRGERPAGEVPKTLHFKLVLLGDTSVGKSCLVVRFAKDEFYEYQESTIGAAFMTQSVDLGSCIVKFEIWDTAGQERYRSLAPMYYRGAAAAVVVYDISNRDSFQGAKSWVQELQTVNDRSNVVIALAGNKEDLGAERQVPKQEAQQYADEHGILFIETSAKTGHNVNELFYEIAAALPKSRKEHDPHAGFQLNKTQEQKSSSGSWCACGGKSS

SEQ ID NO: 479 - protein, 232 aa, Neospora caninum
MSPSQVASSRLAQSRGSARGVWGGRRSLLFLVCLLALLAERAGAFQAVVELGPGQRRCVGEQLSRHVLVVGEFHIIYPVAATSQGGNMLVVAEDPVNHAPIFKQQGKDHVRTAFTTALTGTHTFCVSNTGRLKLTVDLRMVWGPEARDYSQIAKAEHLDEVMVQLLRLQDRLKLYHANVLYMREKESKMREASDSTASRLMTFCIVNMVLLVLAALASAYYFKRFFRSKKII

SEQ ID NO: 480 - protein, 450 aa, Neospora caninum
MRNKIAVPAESFPSSSSLYHLIFLARKLLARRALGAEPPKSQEATRLDGLLKSQAYQKILRYPGDLWPQEREQKCFPSSAEFDWGSLSQQPVPGFDVQPLPPWMHSANVEEVELAPSYVNVRHKSALLKAAWFSCPRAFRARLELSESDAGSSGVDDALSTTSHDVEEQKEIGQVPRLPVLLYTPALDTRTRRPLNPILFASRRLVSPKGAESGDRCSSSSDFPRHHLTGRGVLGKWGANHAADALLTARNPVNGKLQVALIRRTDGSGKFAVPGGFVDPTDGPLVVTPIVREFLEEAVSYEDGDHTDDGHRRYQETLGALRNVFGPFSRDSKTGGILWQSDDKIKWGHLIYAGYVDDERNTNNAWMETIVLHWHVSGEDYKHLHLQAGDDASLGSAAFYDIDEDPRLVVMGVDPLKDLYASHSAFLVKTIETYFPDETVLLTKIGAFRR

SEQ ID NO: 481 - protein, 438 aa, Neospora caninum
MAALSPQKVAELKAFIGMCERDPSILHRPELAFFKEYLQSLNAEIPAEMPARGGSPEKPATAPVPEESSDEESSESEVEEFDEESLKDSEVIPPETNPPPPLAPEGQKELTDDEQDKLGKLKEEAAAACEAGECETALAKYTEALLIGNPTALLYTRRADVLLKLKRPVACIRDCDEALKLNPDSARAYKIRGKANRLLGKWREAHSDLDMGQKIDYDEGLWDMQKLVDEKFRKIEEHERKILRKREEAEKKRREKEAKKRRAAAQRAYEEQKQRDASGSGKSLRLHTKRRRRGFPGGFPEGFPGYGGGAGFPGGAGGFGFPGGMPGTFAGSSCGGPGMTGTPGGCCGGMGGGCGAPGMPSDSMPGGAGNLFGALNDPELKKLFENPKMMAAFQDIMSNPSSISKYASDPEVMAALGSLTSKFGGGMPAAGFPTGSPM

SEQ ID NO: 482 - protein, 550 aa, Neospora caninum
MKALKMLLHRTTCHVLCLLLLAKVAAQGQDRTSITADHDEGQGEVDTPDIAKDGSSTVANRQNLNDSVAASHDVDCDPTWDGIPPEASYQIVFTTRAALSEMGVQVHRGNVEPVFKNRVRIPSVSDMLDETAIKRHEDQLMAGGFVLQTAEHVVLLKPEGKFLECNYCAGDATYQVVQLLSVGEDDDGIVFHFVSLTYPTWKFGSFLLSIPGSALAFHGNKKPAINDVGLLACIGRGYQPVFFPKPLETGSQAPVFRTGPFQEKVDVVNVRAFRGSQQNTSLLEVTLSLRESTHAVAHVMKEGTTVVYYASVFGPPVVQSALVLGSFTAKRKWWLQRNTRTGPVLLKCSAWESLIKKTIRRLSGQGQLITKRRSRKPWIIAGLLGATTLLSVGSIVKGYRRDSQRGVNVWNYGVGLLPDRVRASFRIGEISSLSASVNPYNLVTAAGVASADTILDSRVIRAAVNTSGLRGAANAVLLKGGGLYGAGASVAAAVLLIKYHAIRGAWRAVKKRLAQQELNDIVGDVIGAAKGDEISTRLRRGTLFVVLDEA

SEQ ID NO: 483 - protein, 501 aa, Neospora caninum
MTDATHVAAKNAVEEGLSSGDRAKSMELANQATAGASLSSFEVGCPNQEVSKAQGQLEGSETAVPRVAFGLSRYVVLVAYCLYCLLSGPSFMNWTTIADSLYMSGAFEWECKPGEIDFTVLSHEPKCPEQEISVNYLFTVASCSYFVFAMLGGIMLDFAGPKFGAFTGLACLVVGWTLFGLSSESFRAYVPAAVLMGAGIDMAFFPCLCGANLFPGKGATIIAILGSFRSISFIVGVTLRTIYMNVEGATFRGVMLGYVGVGLGLCVLVAVLIIPSKAWMAPDAPASASSEDDVEAGADALVKQEKNLTAVQSIKRDFLSLSFLPLFPYFVLVLIAILFFAPSAKRLIPSAYEANQIISIFSFVPCILLGWVADRVGIVPVMMICNSCGLISWILMLIPGIPCFVASQFIVSILISIQMSFLVSQIYCYVAEVFLPENMGKMIGFLCSVGGIISLVTDPMRKYSVDNGFYTMTVLCLIFAAVNEGLLLFMYVRKKKVPKVL

SEQ ID NO: 484 - protein, 554 aa, Neospora caninum
MERKLADRRSNFKKNFEDPRRKREDLQLQIRKTHREQNLAKKRAEALDSQDGSLAGNAGMFSGMGGASVADGSMAPGMAGQQGQENVFKFEHLPQMMSMLSSGDPEQEFEATEQFRRALSIESRPPIQEVIEAGAVPLFVQFLRRSDQPRMQFEAAWALTNIASGTQEQTQVVIEHGAVPIFVELLSSPTEDVREQAVWALGNIAGDSPQCRDLVLQAGVLSPLLAQLNDSEAKFTMQRNATWTLSNLCRGKPQPPFEWVQPALTTLAKLIYSTDTEVLTDACWALSYISDGPNERIEAVIEAGVSRRLVELLGHKSTLVQTPALRTVGNIVTGDDRQTEVVILCGAVPALLMLLSSPKKAIRKEACWTISNITAGNRDQIQQVIDAGLIHPLIELLSTADFDVRKEAAWAISNAASGGSNAQVEALVECGCIRPLCSLLAVQDSKIVSVALEALENILRVGKMKKEQQQLAENPFCELIEQADGITVIEKLQDAANQDIYEKAWRIICNYFSFEEADVDDVDVDASAGAGMADAGQVNAFGAAPPQGGFNFGQ

SEQ ID NO: 485 - protein, 738 aa, Neospora caninum
MAPAGFQSGRSQQSRLANRGGAPKAHKRLHLTPLHLLAFSFAAGLSLLHSPASPRWALLAPLPAIVSTEAVVADVVRRAKDAVGHGWRNGSRQIAEQFGVSHAYMKTVLPRSDPLGFEKYKLLASRYAELTQEIRDAAGTKDFEAIVKRSGREQEALLEEVDRVLEQALDPSLRPQLSGTRHARRGANAAHRESTGSASSSRTSSGRERSEHSRWGLPPEKRVQSVRSARPEGSQVRHGDSPGVDGGDAYGIELTPEQRLERGSLLQRLVLVSYRQRQAASEEEATRLEETKQRLLHQLMEFDARVQRQRYEGPSSFFNREDAMNQVMEERLRREQHVAARMVEAEMVLEETVRSLGDARAVLTELEAVPGHAAQIRERISTKLDELREATAAREGCVLDAFILSGGLENETQNLVASARARGGESLGRVRTALSRCAAGVNSLDALIREVGGIEDPGLQSRAHTYSERRHVMQFETAQIQAAAERIVTDMEVKQLQLETEAGKLQEVVGAISEACLAFFKKEEERLQAVSSKVAERVTPLLAALQRIFETAAALGQKQDLEAAQAAQQHLGRASAGVDRLPSTALPPAESVPESQEDTVEFKALKLQKELEPIVSEVSGVSTDARTAERQIMALMAAVATLPADAGTALATNIARVHDAITRAEQGVVAALSQAQAQVSVVVSKARRSRQAAASFGAFRLMHPTSWPSPHLRNDGARLGQMNADARLRQASAWTGHN

SEQ ID NO: 486 - protein, 393 aa, Neospora caninum
MGGVCSKSTADSSKGRNSESKATEAERAVAVAEGLQTAQKIEAVTGAPAAVTEDGDVIVAVDEEDKKSIKGEKTNIVDEAAAAVVSRSPEPAAVIRKEEVVTEEGKNGDTRVHVSVVEAVISSDLADLPEQVEHVSPRDLELLRQAREQVKATGGPVITDVTNSDGQNRREYKPRASAYGYLLYVPDKGGSLILLWLKQELSPEEEEKAGKILVSFVPALHKSVPRMKYEQKGGKTELLTGIEDKWSVWKANEKQKYYAAWATVLKTCDEYEATLCVRNWTEDMPPQVFLSLLHVGPVGNKVATLPRDRPVDLSVFSHVAVVPADKSKEFKEGHDLSEKKFQDLIAAAGGAHQRLVPRGNAAKLGQNDVVAWFKEDGIDISDNKQGLILDGKK

SEQ ID NO: 487 - protein, 813 aa, Neospora caninum
MPSGLDAASNLASGASPFSLSLVSRPSVLLALAAEDASDALDETKGTAGQSVQERAQALGAPAPLGRRRRTSGLVWQEEVYASARDGKHADERARVVGTPSANDANSEDGRASQSEENRRDASKFSPLPYTGASRVSLQKADSADDDAGTTNVEKLLRNVGRLNSELAADVQENQILTTQIVGSTVLALKAKSLQLGGLEKAVGVLKSNVRVGQWRVSEFLDLIRAKASERQALFRERLSNIRDRINELSGSIILQTMAGLRGAVEDLKNEADAMLLGEKYSSRMKQVELQLLGNAMKLDELRGTLKQARARIDTWMSGAANVVQQMGRDATRLAQAGQEFFLNTAAAILRQKEEEFALFSSTPRVELTYGDMVVDQILRDFASADVSVIDVSSWLQGISGKKPATVDKVAGTLLSKLRVADPSLNIRAVFCFIPPYPGVARLDSVRFHIVPDLHIVQTALSHLQKIDVPRSYALLSVDQVLIQSQIVAFDGTGKRAASAVFVQKPRGSHGDVVLSRVDTYGLAFRRNLTGPSGDVIHQALRATANTKVLLVYAGQRPATSSNGDASMRHHSMSYLTEAGSRAAEFARYQQQSLPELQQLSVRLRAELRFFTTIERNCKKAIVSADIPPDVQQALHLPPLSLGVYRIYHVNRTAVFAAFAEVPLPPLPLSSFFRSSVGMLRLDIARSSYGNRDFAVPPRAALAQALSILLSQQVDGDAAVTIRTQVTSDTRLSWIRSKKARASIHLQTSVTPPLYVSHYAIADIRNEYLTPQSILTAVADYVANKFLSQNFVRYRDKLEGRVLYIQISHQDQR

SEQ ID NO: 488 - protein, 531 aa, Neospora caninum
MASKQPQTLSVGTVESGRVARLVSASSVMTQQLGKSTNIRMSQILEPRSEEDWTAHRTRIVCTMGPACWNVDTLVKMIDAGMNVCRLNFSHGDHETHARTVQNIQEAMKQRPEARLAILLDTKGPEIRTGFLKDHKPITLQQGASLKIVTDYNFIGDETTIACSYAALPQSVKPGNTILIADGSLSVKVVEVGSDYVIAQAQNTATIGERKNMNLPNVKVQLPVIGEKDKHDILNFGIPMGCNFIAASFVQSADDVRYIRGLLGPRGRHIRIIPKIENVEGLINFDEILAEADGIMIARGDLGMEIPPEKVFLAQKMMIAKCNVVGKPVITATQMLESMIKNPRPTRAEAADVANAVLDGTDCVMLSGETANGEFPVITVETMARICYEAETCVDYPALYRAMCLAVPPPISTQEAVARAAVETAECVNAAIILALTETGQTARLIAKYRPMQPILALSASESTIKHLQVIRGVTTMQVPSFQGTDHVIRNAIVVAKERELVTEGESIVAVHGMKEEVAGSSNLLKVLIVE

SEQ ID NO: 489 - protein, 432 aa, Neospora caninum
MYSLGVEGDETLPAQQAFVSAPSIEGYSKAPTGQNGMRSPGSGSFDFGQQLTRQLTQAINENLRPPTEIDDTPRGEHHSPFIYFFTSALLRIGSSLQAACLLFMCLFYLAFGGGGLFVFDEFAGPESVRMSDAFHLITSILMIGYLMGTFGIALFQLFVADSSKWTRGFRAGSKTLSCAVTLDAVSGCLRVVQYIHAYLFSSVQWWAKYQRTQSDWGLYHFSSTLHAFALVMYGVGFFLLESYHDQGTYEEYAWSMLGLYTTAGLAELFMVYTGYGAFFTLLLVAALIVTVNWAFQFEPLLEKWSPDLHSRNLNENMLPFCDVGTESEASAPVTHQATSGTLAYGPTRYLTRELPVDDASSLHRSASVLSGHRTAGYSESGAVGVPLSTFSSSVPGVNEMPTAYDYSALHQQIANSGVEPGLVRSTGSRQYQ

SEQ ID NO: 490 - protein, 1181 aa, Neospora caninum
MSAGVATQLLPSGKALPSSSAMGRPSAAPPASSAAGVLALLHERDPALQAAALHRLLQMIDLWWTEIADYLADIEELYEDESFAERQLAGYIASRVYFHLEEYGEAMKFALGSGKWFDITQKSLYVQRILAECVDTFIRNGLRDFAPQQLAAGRQVSVQLPEEDMEDGQDAASSAALNEAVEGVVKRLLEVCTQGEGPLYALGIAFDARRLDLVQAIFNSPRARALPPTDPNSHCQLMLYCLDHIQTLISSKFFRSQIISLLTAEFEKCLPLYDFPSAASTAGAEATSFGPGRAEVRGLVYSGLCRCLVERDESGRVAELLHRLLQPQEDPSREEEGVLMACQIAFDILQMESQPFQQALLDHPLLRAPEPPAPAAGDATEGGETATPNGTASDAAVQDEKEEKKEVETEAEKKRSIDTRSSLLHHGVVLSHMLMQAGTSCDVFLRCNLDWMARASNWARFSATASLGVVHKGHVRDSMKLLRTYLPASSSASSSPYSEGGAFYALGLISANQPSSSVRDYLLEQLQAAGTASEPRQQGCCLGLGLVCMGNADDSEVYEALKQVLFLDSAVAGEAAALGAGLLLLGSANAPAVAELLAYAQDTQHEKIRRACGIAIALLIKESDALIRYGGMFTIAMAYCATANSSAIRRLLHVSVSDVSDDVRRAAVIALGFVLCGDRQQLAQILKILSGSFNPHVRYGAALALGMASAGTGRKEVVDLLLPLSNDSTDFVRQGAFIGLGFVLQQVPDAACSEAGAVRQQFQRVIADKHEDVMARFGALLASGLIDAGGRNVVASMFSASGVLRQEAAVGFCLAFQLWYWYPLIHMVALSFAPSALIGLTVSSAHAIKKKPASASASSEKAGEKGEKDEKAKEEKEEKEKREEDEKAAESGEKNESLVSREETHEPYVAGLSKLRVPAGWTVACVGAKKGQFAYVPSLASLEKKEGKKQTIKAVLSTTAKRNRKLQEQKKKENQEEKKEPSQESTKGADAMDVDEEPAKKEDEVPKKGEEAKSKTEKEGDDEGKDGAGKEVELKNPCRVLPQQQPCIQLLANSRYQPIFPGRKAGFVLLRDTRSAQKPDTFELHLSSYIYIWMHAHADRCTYKRVCIYIYIYIYIYIFAEVHVRGGSVGLGRVCGCVAESIRAHFVDKKFDRFRVPLSPLALDVDRCACACSCEGRWNGV

SEQ ID NO: 491 - protein, 2249 aa, Neospora caninum
MRDGDRPRLGRGMSDPMASLEGAAAFAGKLKPTKEECLAEEHEGRVASKTDAVGTVNDAAGAEKSRDDLRDAGPEGKSAGRGDGALGDEEFYAEGVAAVSMVEEDELEAPLRMLSWWAALLPQTRGEVMTELGGSYLFFVHGDSLILHLLRKNYVDLDVEQGIQPLLYIHLIEKQLLSLVSAGAIFHLVFFRVFEDVAVGDSRDAVPAMFLLIREQLLLYLSVMKIDFTVVDDWFSGDWRSLMKRKHPTFLLIDDIHFSPEETGDTEDEEEEEEEEEEEEEEGTGESARRALWKLPGGMPTEVVALQEEARKNVGNRGRAWVSYLLQSLMLSSLSRNLHVALMHDCVYKKTKAYCLAIAPTVAGALWVQLERRRKADEERRKEAAEAEDRDLAENRSGGAEAETERADKQGEKQDAIEEFHARELMLRALEVYGGLLLPEKDEEEIEKEKEEEKQLLEEVRKLGEGGGLRQLLAEKFCVFLRAIAAEEDDGEDEEDEGKEQIKQFLAIGKMFLMTATVMGELSIRERSHYTVSSKAPFITEYLYAPLKLYTTEATKTLRQLRSLYTSSTEIAEELQKSILIPEEIADFFDGKLFFTVMAYACDFARTSSDWSLPASFFGLTARGVEILDGSWQAVVASHPSAVPLFLQPLFPIDLQPLASQLEALPLPLADAPEQDEAEDVEPSAHLLALHNSFLRKFRAAGPEGALPHAPATSLETSAELRRRELKIRREGDSEEAERESESDQEREELIDRVEEAANDTFTEPPPDGALDFAKLQMCYLNSQEYTPPERELQKMEHMNGEQKRKHLDMLERKRKQQLQVTIRRKAKSLCPYPLHLPISGAYDDSHPWIKIDQEAQEREEAERAADGRGAPKGKKTEKDKKAKPTAAKAGKEETKPLKKADLIRMKNAGVQQKKVQNLDAERLADLEKRVEALCAEYNALSSRSSLQSSFSYAGCTYSLSAANLLALLLDVLVGPSRRMSLILGFPYVTQLLKMRDAQRSFIMKVQKLATDAFSGFRKECIDSKAHFAEMQKLFNALFRINVEAFRMFKGELEGKEIEDIQRSLFSLGFNQAAERLFEEWKVERLAYLDALKEQEVEKTEQQMLLAGGGKGGKGKEKKGKDKADAKKGKGANAAAESKAKKESLAALDVHRVSRAMLFDFRVKKGSVRLLDLIDRRESVFVTAPTSSGKTFICFYAMELVLRCPMRGEKAIDNDAVIVYVSPSKALADQVYAEVHGRFSSKTYSASGSRKYLAANFVERQNSEPPLNAQVIVTLPHILEMLLMSGAFARWNLNLRYVILDEIHCISEEEGGSQWERLVKLLPCPFLAMSATVGNPDSFLHWMRSANPSTPITHIDYKERFSDLHMVLYHEKKLLPLNPVCSVHYDKVKLGGLASDFYVPPNDGLNVYLLIRSLLGEKHPFSEQFFPEFYFEGCSAITKKQYRWYWNTLRQALVDLVQREEMSGEQFAEFQQALQDDPATSWTKQLAFFENVETPMAGAIAKALTAGRTEAKKAEARKTDEKDEKSNYLESVMEETEFWKAYLDPDNLIALCRQLDAAELLPCLIFNFHRQEIRQMVLSMTKRLKQLQLDKYYGTEEAAYRTRLANKKRMEQYQAALAQREMEEKMRGLSWQQREAQGLGKNETGSLEDEGVPPPPIDIAEEIDPEFSFASLKAMGTNFDDIKDIIERVKRRAVSATDRLLVEALRRGIGVYDNGLPKAFREAVDILFRIGYLRICICSNALALGMNMPCRTSVFAGDSFMLTPTMFKQSGGRAGRRGYDAAGYILFWEVPFSKINRLLEARLPIFGGDFPVSPMLTLRTLRYHEQLERLAVEGDVLNAATVEKWEAALLRLYLYPLFAVSKDNTRPSVAYEENLRLYVRFQFRFMTDLLQRLGLLHDGRIEDGFGHGISVWGHMVELSYQQETAGFLLHFLLFSGLLEERLAELKSEKAREALLLHFLATCICQQTVTSGQLLRHKLRHERTMAHVRQESGFQRGALVVTEKTAHDVPQFRPFMALLPDEMEQAIQAYNEMAFLTSVRCLRAAGTLLANRESNASAEVEVPFSHTSFPREKKDREESEKRTGSKDRCVNREASEFFTLYQRLIRSGKIRSPFTAICCRSDSDFKSLAELQDCVGPSTPFYPETMSAELPCAYTWMRYWDPKQKREVKAKVRNQNQYLMDLRVTGTFKHVTRYDEISPGKIWFLIHNFVDTLLYLKRTPPQCVEKNPVSHSVIVSLHQAMNEIFEKESK

SEQ ID NO: 492 - protein, 1386 aa, Neospora caninum
METGQFRDLGRLLEDESSRGVGTPHGFVPPDSASRHGDPHRVDAQDLTTFAPVNADCLGEDIARPDENEVPERAAERPETVDPVESPLPGAPIPNVYAAKTISGGVAHDDMLGHRRQNVLNDEQVATTRGLFKELDVEAKGLLDPNQIGTLLNTLGYQLSEEELQQAMDDYDVEYEDGLNEDNLVQLVEEVEASTVQKRKLFEAFALMDVDSSGIIDIARLQALLCGTEGGGAEDVPDPLSEAEFAYFMLEARAMKDGRFDYRRFVNDLLFSKAPIEPVGGKKKGKGKRKKKRPEWNLNLSPCVFARLAGGAVARPPDTAPAEQHTLFTEAAALWVRGVLLRILNGHPEQTAWLNLAYWESPQRSTQVAAFCSRYLWAGAVVYMATWVLVSLLFKSTKPAKHDQQRRAAEDKCGERRSPPRPPSAVLMVWNAIVGFVAFLAIAALVEDDSSMFLSPLFRLPTSYRPVARAVVSLVAPVTFTFFFADTLLCLVLEGAGRTTFTHFVGHLYLPLFLNFCVGTGLPAVHTLALLHLAGVAFGRTLDVASTAAFFASLSLSRREESLSAPKGGSGSGEGRAEDPSHTQKDETKHASEETGGPKTGDASSADLKTLDSDAEGGFGRATLIRCHRLLEVVQPWVTAAVCLCALYDPTTSLLPGAASMWTACKWGVGMEILLSYYSLSVYLSHYHQELRAFMFAFLMYFHVFAFVGILLLLSHPSAWRLFFEVTGFYMVGGLGITCGAHRLWAHRAYKAALPWRIAMLILNSFANQGSIYHWSRDHRVHHKNSDSVGDPYNATKGFFYCHMGWLLYKKPAEVSIAGRDIDCSDLLEDPCVLLQKKLDPWWNQFFCFVLPGLYGYYVYNSFWLGFFAHGALRWCMTLHATWTVNSVAHFWGDRPYAPQTRPSESIFTAFVAVGEGWHNWHHMYPYDYAAAEGGVFENYNPSKLVIDTGALFGLVWNRRRATTAWQRAREKRDELMRQEEEKLLQRSGADKQIIYMESIKQMFPARVYRVHTFANLAVLLRDVLLVAGLSFVAYRFLGVAALLELLAAPSPSPLLRAAQFTLLVGLSVAFAAATGTLWFALFVHATEAANGKFSSSPLLNHAVAACIQAALLVPYKPRRAGEPFEAPAIRQVRKQDEICRKEGKHALPAPVPALSPLTFRPCLFDSCFRFAHLAGANCWQTSFFTCIGVFAALAWLAGSQGYLSEVLIFYVGPYLVCNAWMAYYYGLLEGGGPHDVTNEENNVNFKIAAPSALRWMRDVSDERRRTRKAHRGGLLWKWIDHLHHELPKKHLIQALTYDVSRQGLGEASRILRQRLATAPEFSTESDAELETEATRASGLEEEILLAQGDEGQLKSGDAKRKTSVLAPNEELKRREAAAALRACGC

SEQ ID NO: 493 - protein, 2597 aa, Neospora caninum
MSFLPPSDRAGLPPVERGAQDPLRISPQRASAGEVPREARDTSSPPSVHLTASTQMAPVHGSAIPRLDLSRAEAIQSQRVNIAAGTTSVKPTGSQVGAGASAMTGSLGNMYVSNAGVPPTGATMSPWGYPYGMFSSVAVPPRGVVEHMLVEPSNRTSTPVGERVVQLRGFRSAANSSQRTTTSVTRRAEEGIEIPVSLAADALIDLSTTRSQKIADGCRCCAGPLSALFGQRGRQPLPSEPRSREPASLTVSPSQSRTAFRYGSFADPVNTYQERLASVPHPMMTHVPVNAFPVGSVPSVVLVPAAVFAGRNGDQQGKKSTDVERPAKEQRPRASREGEETRASHRKAPGVEEKKLPSERACEKLEVRAGAQEELEGQLTVSAEGKEELDWSSVAKAGASEAANERAGEPAAPAKPETVQSWGAHSVGRAAREDSTLANASVATWSFPPRAGSSTSGVPFNAGDAGVARAVAHAPSGTRECLPAITDAGVQAGARNVGGESAGQCSTRSLAIWHQLEETKEQYRRVQEQFVKENESLKDENLRLQEAVVSMQSRVKHIIDLLHSLTKNVGQKEATDAANEELAEACIGLVTQLVNEGEAGLKAGGSEGEAARPETLAEAEAPVQLGPLGGFASFTEEQLQQLLSLQRQGSGKERTEQTNAKEAQSGGGGSGSSGVDARAPQDPVSKGVVSAASSSKAAAPGAQRRPPLGFGSASPRPLSIVEKNSGEPATRQKPQRPDATPNASREVQPDGAAKPGSGDASLEKHLVRPPLETATSASTSPANPTSDAQAAPEEGARGHIVAPHGTLQTEEPQADPEAKNALKAPEEQAAAPPPSMSTDAPKTPAAKVAAEPKVPTPKPVSGGENPAVADAERDVEEPAEGKRAAQSAESGEPQREASLASTENKQPATAKAPVTTGPAAKALVPKMGLLAKPAAEKKAPAPKTPTMDSSHNEKTSATVEEKKDEKTPGAVTAVDAELAPQRSVSSGLAGFFYNIFGAPAAETSAEAVEKAAEDTEKKMADSEDKHVPSPAAAPLVPKEAASKVVPVAKEAPKAPVVPKDAPKAAPEAADAPKAAETPDAPKAAETTDAPKAEPGAKAAPKLAPLPKNVVKAPLVPKAEAVAKAVPEEAAAKEADAKVVPGAKEAPKAPLVPKHAPTAPLVPKEAAAKVAPVAKEAPKAPLAPKDAPKAAPEATDAPKAEPGAKAAPKLAPLPKNVVKAPLVPKAEAVAKAVPEEAAAKEADAKVVPGAKEAPKAVPVAKEALKTPPVAKEAPKAPLVGQEPPKAPLVPKDALTAPLVPKAEAVAKAVPEEAAAKEAAAKVVPVAKEAPKAVPVVKEAPKTPLVPKDAPKTAPAATDAPKAEPGAKVAPKLAPLPKNVAKAPLVPKDEAVAKAVPEEAAAKEADAKVVPGAKEAPKAVAVAKEAPKTPPVAKEAPKAPLVPKAEAVEKAVPEDAAAKEADAKVVPVAKEAPKAPPVAKEAPKAPLVGKEPPKAPLVPKDALKAPLVPKAEAVAKAVPEEAAAKDADAKVVPGAKDAPKAVPVAKEAPKAVAVAKEAPKTPPVAKEAPKAPLVPKAETVAKAVPEEAAAKEADAKVAPVAEEAPKAPLVPKEAAAKVAPVAKEAPKAPLVPKEAPKAPLVPKEAPKAPLVPKEAPKAPLVPKDAPKAPTMDSSHNAKTSAAVEEKKDEKTPGAVTAVDAELAPQRSVSSGLAGFFYNIFGAPAAETSAEAVEKAAEDTEKKMADSEDKHVPSPAAAPLVPKEAASKLVPVAKEAPKAPVVPKDAPKAAPEAADAPKAAETPDAPKAAETTDAPKAEPGANAAPKLAPLPKNVVKAPLAPKAEAVAKAVPEEAAAKEADAKVVPGAKEAPKAVAVAKEAPKSPPVAKEAPKAPIVPKEAPKAPLEPTEAPKAPLVPKEAAAKVAPVAKEAPKAPLAPKDAPKAAPEAADAPKAAETPDAPKAAETTDAPKAEPGAKAAPKLAPLPKNVVKAPLVPKAEAVAKAVPEEAAAKEADAKVVPGAKEAPKAVAVAKEAPKTPPVAKEAPKAPIVPKEAPKAPLVPKEAAVKVAPVPKDAPKAPLVPKEAPKAPLVPKDAPKAPTMDSSHNAKTSATVEEKKDEKTPGAVTAVDAELAPQRSVSSGLAGFFYNIFGAPAAETSAEAVEKAAEDTEKKMADSEDKHVPSPAAAPLVPKEAASKLVPVAKEAPKAPVVPKDAPKAAPEAADAPKAAETPDAPKAAETTDAPKAEPGAKAAPKLAPLPKNVVKAPLVPKDAPKAAPEATDAPKAEPVAKVAPKLGPVPKDAPKAPLVPKAEAVAKASQVPVGVPEKTAASAEVPGAADASKGTPIVKDVLGGEWKSESSANAAPNATAAEEAGSAKEMPKALVAKKSLENMSPAKAGSDTKVVGDTAQERLHKDSPNAGLTKLPSKEVVKKLPSKEVVKKLPSKEVVKKLPPKEVVKKLPPKEVVKKLPSKEGVNKLPSKESVKKLASKEGLKKLPSKESVKKLASKEGLKKLPSKESVKKLASKEGLKKLPSKESVKKLTSKEGLKAQASKEGLKRQESKEGLKKQASKDELRKESSKEGVAVLQSSKSLKTMSSK

SEQ ID NO: 494 - protein, 221 aa, Neospora caninum
MYSWFRAALAPAAAMAKKAVRALSVFVCVAFPALVEATKCLKLHNKFRTAGLDVGVPELVANPTARNVVMDIVKKRAADKCAKEEHSEEARKAGMGENIFYADDANCAIGVKMWYDEVKILKGNYPGTEWNRMGTIGHFTQVMWETSQGMACARTTSCPKWNQLFCVYKPAGNWIGVAPFSEAVWMSILKRDGMSGALSVAQVSAGSLAAVISAVLFILAE

SEQ ID NO: 495 - protein, 346 aa, Neospora caninum
MMRSVSRSVGTSSQQHNVPKHFDILPYPPLKVRVHPVVVLTILDAYLRREEGQMNVIGTLLGTVSEGNVVDISDCFVDRHSLTDEGLLQIIKDHHETMYELKQQVSGSGAKDIVVGWFCTGSEMTELTCAVHGWFKQFNTVSKFHPQPPLTEPIHLMVNTTMDRDNLSIKAYMQVPMNMAKDACFQFQELPLELFASSSDRAGLSLLLKVREANRRHRQQHEGNRASALSSSAPSSAAAVAAISDTPGVAGVPVIKQGLGAALEKLSDQLNKCGAYVRSVLDGSEKADPEIGRFLSKALCVEAVQDLEVFEQMCQNALQDNLMVVHLTSLARLQFAVAEKLNTSFF

SEQ ID NO: 496 - protein, 393 aa, Neospora caninum
MYSLGVEGDETLLAQNQLSMSSRQGSAYMMGHPSMTSTMGAPAMFVDEDAEPSPRGEEHTPIIHFLTTKLLRFSLSLKSVSMALMCIFFLAFGGRWVFTFHAYPDMSNGFHLSMVVLMTIYLVGTLFLALFQAFVADDSKWTKGFRTGSKILSAAVTLDGLAAMLRLVQYLYLYNYLSVVWWTKFNVSKSEWILFTVSNVLDGLSLLSYGWAFFYMEVYHDEGTYEELAWGMFGLFSLSGILMILMVFAGFGAVFMLLTVAGAYATACYWAYLFEPLLEKWSPELHCRDINTDIMPTEGAQQTGAGASSTGYYGTNQTLGSSPGPVYQPLQAGVSSDHVGRMGSASLGNAVMGSYVPQAEAAGMEIPTQYDYSQLQQQVSREVEMGVVNPNYQ

SEQ ID NO: 497 - protein, 268 aa, Neospora caninum
MKCQSPQRHRPPSYRSMPSRQASRAALPQKSERLPEIRDRQTPNRLRSGGQRSPARKPFEERQGTTQLERQSTAGKPPCRTPSLARGASQRQEPGPPVRAASRSKVLDGDGSAQPPVPTARGRGSSSTNDRVPTKLSELTPEEKEEEKKRLQALVKEFAKEAVAGFQIDRIDEDTGVQGKVIFSMDRFLTTIDLHSDDNSQLPNISLAMEDLTGIFKGDDAAAHSSVAGDCDHNRILVLTSSEHPVVVLEAASHQHRDKVYTCLKILR

SEQ ID NO: 498 - protein, 242 aa, Neospora caninum
MASSSCIAFSYDDLGLPVVANAPRSALPVPSAAGASAPVSTGTTIVAVSFQGGVVLGADTRTSAGSYVVNRAARKISRVHERMCVCRSGSAADTQAVTQIVKLYIQQYAQELPKGEEPRVEAAANVFQSLCYQHKDALTAGLIVAGYDKVKGGQIYAIPLGGALMPMNYTAGGSGSAFISAFMDANFKDNMTQQEAVELVKKSVAYAISRDGSSGGMIRIVVITKDDMLEECVEGDKLPVAP

SEQ ID NO: 499 - protein, 492 aa, Neospora caninum
MNWPSMEEQAGKKEEQLTESQTPSSWSPAMSPRSSSRASSPPSSQKLFVCSEVFGGTTPTCLTAASRSHIPIQERCAGNRHDSPGTGTALPPRDAARTESGPESEDCVRRSVRKDNLPRTGLFAVAGVHAAELTHLRRLPNGHYRRVGRPRYRSGDEGLFEDPLSRSFHRLKNCTCCVAEDASHMLISPKLSASVRGNGNHGEKKCRNCHILEGKLKDILDGEREVPSRKQSEKETNSVNRLKEKVEQLKEALRVADQRIAAQKQVERKSMENIDALRKILHTLEETQTTGGGLDTDIKQMNNQLNDQEKALREEGFATNVATEDIGVQTKTVGVVFFSDPKLKGGMFVQMLQGSERRTMALRVDYALRLLVLTRRDTIKFIPVLDVVRIVTTSEKLRRLLEKEGNYRQDVRDEELNRIVAFFVEAGKSSLPLFIVLPSEHLRNTLVAHVTQLRFSAEVERGHLTDKGFHGEHLTDGWLDDERGKKYGESPP

SEQ ID NO: 500 - protein, 194 aa, Neospora caninum
MEEELTPEILAARAKLRERFGQASQQLGGKGTARRKTKKVHKSVVVDDKKLQLTLKRLGVSTIYGIEEVLMIQDNGKALQFLTPKVQAAPAANTYVVSGHYEERANMFPGGLPGMFSQRGAGGAGGMNFDTSLITPDMLRQLQQHMSALKTGAGSAAEGTASGAGEGAAGTDDAKKGEDDVPELVQNFEDVSEQ

SEQ ID NO: 501 - protein, 262 aa, Neospora caninum
MPPRILYLHGLEGGRGSDKEKMLEKVFGKQDVKAVNLKTRQTIMLFTGLFTLVAILFVCAFVACFIVLKWYIGLLVTLLGILLLVGGYWVAGRVVTQYMVKQAKRLAEKKFKEFKPNVIVAETFGAVVALSMNVPKVAMLLLSPAQDQYTRFMKMTTYWGIGAYPYVMVVHGSHDKTIPLDDSVRLIETSEVGRCRLEVVDDNHALKGVTEEDLQNWVKEVYTIGKQQARKMAAAGDKHVDASLFGDEEDDVKTSVGTAEAV

SEQ ID NO: 502 - protein, 1133 aa, Neospora caninum
MPPPTRTSVSASRRPDPENTEGGDVAAMEPRSVSDGAARPGRGERRGELERKERGVGAERAWRPVSRRDSSRRVSPADERRGNREEKGGDAAHVASPCREGGKNGESDSEVPETQAVSEEAPSALNPLAHVDPRKIQPSSLRVQNRPGGGVSTEKSRTSARFFAGLAVAMVLCVVACLYLLREKPNNPLGLLTHAPFEVAWVSRALASFFSLSVSLGGSPTVSSLSSLSAFGRDRHVAASEGQAFEPSLLGNLSDAAVSLPFSADVDAATGVDADFLDSLSPWEVREFLLADGWSETPNHRSAPLVLPDILPRLPRAGGGEHLRRHHHLIDGAASPSLPVTAEVALERGRQLLTANVYEEARLVLDQAVREGHLTRAVRMHGQFLYPWKLFSDAEREVLRLTADQVRWFPKWVKNHRNSQRVERSVLDAFLPVLPPQFTDRYGGPGSPEENRTPGIRFTWLGHASGLVNVDGLKILIDPMFDADLIGPYSEWLRSVMKYISSLCGSLGERHRKPPCEYDGLPSDVDVVLLSHNHPDHIMEHDAHAICTQYAKKFRRALWYVPEGVTGFLRQQGCLPSSVFEFSWGESRTLSCHARHGRRVCSDGVWHKRHAKAETFKFTFTAGVHWSGRSPSKIDHNASLWGGFAVAGPKHKFFYGGDTAYWRPDFDEYRKIGQVLGPFHLAALPIGAYEPNADLRYQHVKPWETVQMFHDVRAETAVGVHWGTLRLSAEEFFDPMLDLECALLNVNEEDCKKTTELQHRYVAAHALLTHLPKGVDAASSSPAKESEASGTAAQGTSDWDVLERPASSGSADKYRSRRRSPSFGDDNVEAVPSANLNTGPAFAWDAERSQAVGEASRHKNWTEMFFSHSMDDLMKDEMGRSGRDSRGRYGASDGKSEGNGPYTAFPDDLSLSPSQFDSMASSESGAVDGMHAKKRKEVKFQGKGAREKNGVSDTNGEANNYGIEERVALAGGLPPLPEQAKLVADLLMKLENMMVAQAHPYRHASNIQRLLRSLKLQDAGVLADDDAWKEQLLTDGARFQTLFVGQSLQVEEAEGSDYLLMTRSSGLQHVWPEAPNESYTFTFKHFERGGARKQRRRDKDPGDIFPSVYSWRDGQTPEDGFPSLSSEEPGLFI

SEQ ID NO: 503 - protein, 564 aa, Neospora caninum
MPDRRSRSRSRSPRRDENREERKRKKRTGWDVGAEEGATPTIPGLAGTGLAGLSVTQALAQQQNNLLMQNFQNKAMCRIYVGSLDYYLTELEIKSVFQAFGTIVSVDMPKEGDRSKGFCFVEYASPEAAEMALSTMQNFVLKGRTIKVGRPTAVGTGGQQLQRPAMMMPTVSTMGAVGGLTGVAAGTSPGSMVNSAQAGAAAATAILAGRTGTADPSSLGAALRDQKFAGVEGREFSAATGLLSTGQTAVLTPEQQQMQQQLLQQQQQMANNRVYIGNVPFGFSSEDLKKIFVVFGPILSCQLLPSQENPQQHRGYGFIEYATADAAKLAIETMNGFEVAGKQLKVNFATAMRNSPVVGTPLASTLLPTMGGLPGASPATAGLVPGLSPAGALGATAVGGLTGLTPGVPTPAAPGGLMGAAASPAATGAVAGTPAPPAVNGTSESAGADGGKERQGEKEDEDLPPAPAAADIHSRVVLLTNMVTPSEVDGELKDEVRDECSKFGGIKRVEVHTLKDTVRIFVEFSDLSGAREAIPSLHGRWFGGRQIIANTYDEELFHQGEYEA

SEQ ID NO: 504 - protein, 454 aa, Neospora caninum
MDASKTSEKDGAVAQPGADIELISNRLEAVKIDNKDEEENEILSGLTPEQRAAVEELQAIQEKHDDLERAYDRELVALKMKYEKLYAPLYAQRKERLLKSDPANPAAQSGTPAVPSFWMNCLKQNSTLAELVEEHDEPILQFLENISCEYFTAEEQAELEKKAGKEAEDAAEAATPESFRLVFEFSPNDFFTPNRLVKEYHLTSASARHGAELTSTKSTAIEWKEGKDVTKKVLTRKQRNKKTRQTRTVEEVVDNESFFNFFTDHEIPSEEKIETMSDKQIGELQMIVEADYDIGVTIRDKIIPQAVEWFLGEADDDEQFDDDFEDDEDDDDEMLSDEDDDSDEDEQPRRGGAGVRGHPRGKGGKRLCFLAEREQFSRLGFSPCRPPLRVKILNSCATGIRFAGSAPSDTVADRESLSFTVELCEGCATRDSTASQPLPRENLRREPLSGEAFW

SEQ ID NO: 505 - protein, 1298 aa, Neospora caninum
MPEGVGVGQETSHQSTAVPPKNLLFGAEFLCLANPSVTAAVFRASRCARCYRPHHSPGHPPFPGEELSSGRPLHLLTTPKDADFPQTKGSRKNEVPPRLHCVGSVRRQSSRESACTKSRSPSLEFRTASPCAPDGQPTASERDTASPPLYGCLCPRSKRLGRAPGRAHFYASEWRGGRRVFRASAEHLGALNRFSTKCRGIRLCAMDMRLETPLCPTPGCALLLAVLLLTASLLSHTSPFEQVRLCFTSVFEMSRHIAKTFWDAVSAAELPHCLKAAFSTSLGLHPAWRAAATAVFPFLALAAGVAVLFLLFTGPYIVEESLEIVANFGVQLQHKTRWGGIKRQFIEASQVSDVIINEGFRVCDVVFYVALLVKDRPNMVVPFQLLPFFVQGGMGPYLADCLFLPWRPKMKLTRFRDAHAPKLCLLVSLLLSALFLIYGRCKASNGDSVPQPATLKRMAEPLPFVQKKTLFLIANEPVLESHVVSNLLHQLLYTLQVPNSHVQLLDEILLSEHGKTNHATLLPWLLNVHRELPSDIEFVWLGTAYSRVAASYLEKLMARLTSEAQNTGDASTSRQWYPHGLCVGHALKDQVLSITHHFYRDDAFVYPFLDAGLLMDRRFLRFLEQTVKEEGAQLPPRIEIDPVHELFKFLYQTRGFLMQHSNLFCPSSPIPRDFDRTEVLYPPRHKRPSKVASQAHTQGNDHGSDSGGEYKGGTAKGMAGSRQSPALSAAEQRDIQGCVSFAVGCRHSPILSHQFFDRMLAYEHDMIERKEALAEQYPIGADAGEDSEFREKEAALMSERPFFIVEPEDVLIAVKTHPRNHKTRVPLLKQLWAEPDVVVEMAQRRAKASAHAHPFHAAVAEQERASLDKHMRNIAIEFFSEKTDDGAPDITNVIPVQVSFPGEKRALCEKMRGIFKHFYENHKTRKYLAIVDDDTLVNVRHLLDAISMTLHPPVPARVFFRQALSDQNAIRKAHAPYKELANSIDTFLADWRSKRGLQRPSESERQGNHESPAHQEEANQQGSGTKKQDKLGPEDAVATFVESFVSKVYVKNRAADEASSDGRKKYADMVDRISPLYLGRRYSFGHMQSGDRRTGGYDYITMGGGVVLDREAVGEILECKTCRCPQDGTADDMILGRWMHQLKIPALHGRWFHQERPADYHPEHVRMTTPVSFHRLEKDTATTKKVFNKFVDVGDGLNVGAEEVDDFEAVDWIDFDWQQVEDAVWHDHDEGDGDLDDGEDEELSLHSIVQRVVEEGKKRGKQNMTPDDIADHLEKEVKEHEEKERVHNEDWSWLHDEL

SEQ ID NO: 506 - protein, 982 aa, Neospora caninum
MTDSAPSGASSSPLRLLAGCTVPRAEVAACLAVANALKVPVVLSSKDAAESKARPSQASLAPTPHAPASDPTVDEDKKDACVLVTPDGSVVSAYAVCLYFLSVARKRRRQAEKAAPQQEKRQEGEAAPARDAERDAWQAEDALAWAAFKLRGALRGVRKDRLLQQLNSLEERLSGDPQTSPAAFPSVSSLLAASPSLFVAPAMFMFCLLRYAHPTSSFADWPSLAKFLQALGSSPAVAATLHAVPLPSRACGARALTRALLSSSASPQTEKTRERFYITTAINYTNGPPHMGHVYEAVTSDVVARFHRIAGKEVFFLTGTDEHGQKIANTAERVGKTPQEICDFFAAGFQEMNKKLHISNDQYIRTTQADHKAVCQWLWKRVQEKGDIYLDTYVGWYNEREETFVSEIEARLTDYKDPTSGKPLQKMEEASYFFRMSKYQERLLKHIHDNPDFIRPEERRKNILKRLEEPLLDLSCSRTTFTWGVPVPGDEKHVMYVWFDALTNYYSATAMNDGARSAFWPANVHIIGKDIIWFHTVIWPCMLMAAELPLPKCVFGHGFVTAADGEKMSKSLGNVVDPNDILKEHDADSFRFYLVRETKYGNDLRFDEDALTATTNAELADTLGNLVHRATSLCVKFCGGRVPAVPLPAGGKAPFSIADTVGEMERLVEQFALREALEAAMNACREANKFVTDWAPWSLPDPVEKQRVVRGALEAVFVLAHLLEPFIPVTSAHIFKKLNTQPRILADISPWFDNLTPGTAVDVGDILFAKKKVEKAAEIFLQKCELRVGHIISAAPHPHCLKDPKMPPFLVLSVAFSPTAKPEEARDSGAARTAVVLLSQSAKDGPEKLVGKSVIVLVNVKPFTVKGVLSQVLVLAAKPSDGAAEASLLTVATDSKAPSEAALTGFLVQAPGFPPALRARENLKNTEMKAAAFCVSRAHPHAVALADVGPLQVVDAATGRVREGVSVVVESEAASGPLALAL

SEQ ID NO: 507 - protein, 275 aa, Neospora caninum
MEALHKKIAFVGAGVMAFALAKGFVDSDRVKKDQVYMFVRNETKRSLVEDLGYRSFQSIAGLADVDIIVISVKPQDAVQVLHDIRMVVDKDKHLLISICVGLDIETLARALDPNSLNRRICRVMPNTPSQIRHGVSVFSMGQDCTDEDRTTVESLLSAVGSCYKVQEKHIAAAGAISGSGPAFIFTFLDALSDAGVKNGLPRKLAQDLAMDMVEGSAAFARVEFGRRHFAELKDQVTSPGGTTIAGIAALERWGFRNAIIQAIDATTDRAKDLGC

SEQ ID NO: 508 - protein, 443 aa, Neospora caninum
MGNAQPRGGGFPGGSEEDKEKKKERKRLEAAPPTHVGKRKKRGKGPVGHSKLPTVTPITKCRLRLLRLERIKDYLLLEEEYITNQEQRKPAEEKNEEDVNRVDELRGSPLSVGNLEEIIDEQHAIVSSSIGPEYYVNILSFVDKDILEPGCSVLLHNKTSSIVGILNDEVDPLISVMKVEKAPLETYADIGGLEKQIQEVKEAVEFPLTHPEFFDDIGISPPKGVILYGPPGTGKTLLAKAVANETSATFLRVVGSELIQKYLGDGPKLVREMFKLAHEHAPSIVFIDEIDAVGTKRYDATSGGEKEIQRTMLELLNQLDGFESKGDVKVIMATNRIESLDPALIRPGRIDRKIQLPNPDTKTKRKIFQIHTAKMTMADDVDLEEFVMAKDELSGADIKATCTEAGLLALRERRMKITQEDLRKAKEKALYQKKGNIPESLYL

SEQ ID NO: 509 - protein, 489 aa, Neospora caninum
MANEKETETKQAGAGSERPKVAKNGAQDDEEPKKTIPLDEADINILKSYGLSPYAFAIKRLDTDIKGLSEKITKLCGVRESDTGLCPPSQWDLAADKQLMQEQPLQVARCTKIIYPGGQAPQRNADGGNANGEAGRAGESRPASEGVGASSFGAGAGEDEEPKYIINVKQIAKFVVGLGEKVAAMDIEEGMRVGVDRNKYKIQIPLPPKIDPTVTMMTVEEKPDVTYNDVGGAKEQLEKLREVLELPLLHPERFLSLGIDPPKGVLLYGPPGTGKTLTARAVANRTDACFICVIGSELVQKYVGEGARMVRELFQMARSRRACILFIDEVDAIGGSRGSEGEGNAHGDHEVQRTMLEIVNQLDGFEARGNIKVLMATNRPDTLDPALLRPGRLDRKIEFGLPDLEGRTHIFKIHAKTLSVDRNIRYELLARLCPNSTGADIRSVCTEAGILAIRARKKSISEKNFIDAINRVIKGYKKFSATAKYMVYN

SEQ ID NO: 510 - protein, 502 aa, Neospora caninum
MAVLLLRVGFFFFLILPASARQTQGSLSVLQAAPQPAPESTAIHRLRDERHGGRLGDGVEFSQLQIGGKGRNEDDDGEEYPGEEGEGEEGESSGRASDDGREALNTRETEHEGGYEEENEGVPSTGAAATMAAPIGQEAFPLQLRGDSPQVGYADGQEVCSALGCARVAAGGAPKSPVTGCAKTMKCGGCDGLLEAEARCQAWKPSTRPDVILASGWYFTKHALTRSGAMELDINWDSNRNLDFKKCMPDLRQVTRSFKELQETGNVAPFLFHRMASVQLSVHQLPPEGMEDTGPKKLSFSIKFVDPQSSSLIGRVGQRQNQPMCSSAEATLPLVTLGKKTAMYGVGWLPIPNDLTIPITTKNFVIRMQCSGVESCNMNRIGVCARITCPATAAVAERQMATVQDAMSKPVGEGPVNQVASVASHASGDGVASRVIQASTGRFGAPMRSQVPLAYPGGSPYAHYRGGFPPGYPFYVRGQAAFHAPSAVLSGLTGSFLALIFF

SEQ ID NO: 511 - protein, 1045 aa, Neospora caninum
MMAEQRDRSQRARWTARALFLLAWLAVGLEMLFWNSNSSFVCPKAHAVEVSSSSAERSFSPASTHSPGPRDAAPKLEAASDGQTPLASDTLFLDPSTTSTDEGSAEERFQELEEDEFEHSTSGTAQHSPREDIAVPQDGSESPFTAFISESEPGEESFEPSTRIPREPTEETPAAFSFLQVNAAAALAKGQISPSRIELAKGLAAAALAKGQISPSRIELAKGLAAAALAKGQISPSRIELAKGLAAAPAAPAQKETATQGTRAGRHLLSSTLSSVVKIFVDFTLPDYYSPWQMQAPKEASGSGFVVEGKRILTNGHVVAETTRVLVRKHGNAKKFLARVLATAHEADLALLEVDSEEFWENLQPLPFGGIPRLRDSVTVLGYPTGGDQLSITEGIVSRVGMSAYAHSSVSLLTVQIDAAINPGNSGGPAVVDGRVVGVAFQGFSQLQNVGYIVPYPIVRHFLNDLVLHGRYTGFPSLGVKIAHMENDHLRQFKGLSALTAADLPPGVTPTGVLVVEVDNLRVSRYKTGQIRVPYASRSLAEPRDRLELLQELRAQDEESAPPAAEARTSELGAAESGGQMDAPRFELVSAASAASGDVQSLAHREADGGLAHPAFLQTRITPTHILGSRSQLLRLYALARRRQQVHEVTEGAASPSEGRELVATGHGDRSTPPPIVVNMTVAKLGPGLYAQIPKGAFGPPVIPVSRRLPGIRDWRLQSAPDSAARGENPGVAKDTGHVLEAQEHAQDQAHDEVASGRNALEVQENRVVRGNARGALPNGSPSPTSSEAPNQQTARKAVEPLEEGPRSEEELLLPNPYFPPEQDVEGGELGLKVGDVILAVDGTDVADDGTVAFRQLERVSIDYTIMNRFNGETCKVLVLRDGRVREILVPITNLNLKIPRHTWDQKPKYFVFGGLVFTTLTRQLLEHMKAAEFPAHFYTKIKRSEYQEAEGDEVVVLSVILASELTVGYNAAPAIVTAVQGQKVRGLADVVRIVEESKENFLEFTVKVSGISQMPIVLDRQKAMAVNPKILGQHKILRDRSFFL

SEQ ID NO: 512 - protein, 646 aa, Neospora caninum
MAGVQVWTSATVMASSTLSPVRGGSDGKRNDGLCVELGQSATLMRDTLAEAAATRGPPAPIRPGVGASATSEKDSPHKDGALPNRGSRGSLQSAVPAAATQKAATGELSSPSATDSHPTPGTEAVNDSAAAMVANVSGGTPPEHAGANSREIPADGVPVEEALQAIGDDDPLIHTLPDGMVGRRAPANPFNSPMFAKLRGKKKKVRPKVRDPKLKNNPLRGRLVVCISTTALLCWIFMWEMLYNYTSFNGRCVSPVMYPDYKLETEKQRQPYVIRYGYGGCQYNLGKLAYPRAAFGTDAGDKGWPVDLVPNGSAGASLSSWESPNARILRHLGGLETNYIREYSETFRLFTSMYMHGGWMHILINLSCQIQILWIIEPDWGFWRTTLLFFLGGISGNLLSAVADPCSITVGSSGSMYALLGALIPYCVEYWKSIPRPGCILVFMIVVVIIGILTGMAGFTDNYAHMGGALGGILWGFASITTVSACDKCTLGERMATTPPFSWCVPKKTQEKLLEIAKARKADAIRRRKLQAIQKKKAGGARGKAMYAVKMRLQEEGRPPCKMSFREWVIRGLCAATLLAYWVILFLYLLDPSLYKSYSPPGQLKFSGWLYCKCGTIVYEAPQTYGNLGRFWCFGNEKDASFYLEP

SEQ ID NO: 513 - protein, 2001 aa, Neospora caninum
MAEAMASAEPTPPAASGRELSGSAMGTEGTPLPDGTLSGALTSSPQSFGLAAEANRETGEEGTGRAELQGGGDREQSTSRSLDKTDIALSTQLQLEQLDALQQHVQKQLLEGVSSAAGLAPSADEAANLQVDGEAGAPFGVAEGCGGASEVGAVEGEEACREALAAPKADLTESGIEDKDEVCGPHFSRKGKGWGDDARLGSALSGGTAVEEEGENSSSSSLGFSASSPGGRDGNGDDGNSLLPATSSDADVPGTHEDRLRLLVLQQESMMKQTPGGELPASLEVAGGGRVTPSASDQTFSSLQFSEESQSPQKAGPLPSLLTGKRTRRSGQAPTAATDSAHLSASLSPGGDGETGKIGPSALLFCGEEDPQSSLSTPQGADGRGQSTEATPSSGTHASGDRKAKREDHEPMKTRRLARAAAQAAAAMAAAAAGATDGQGEAAAVKAEGKEFSGYLASPESLASQALAQSSAPLANLAGSHPAGLYLDEASALSGLVPGVGKGGMPVPVPGAECAPAMNAALLPVISTGVLSGPGAPGVPSLLTSGRLSHPGAAGAQAPALAGANAVPQGACAGGAGEYERSDLLMRPGVSYYGGRQAWVAEIKYGGRRRFKVFSVAKYGYEGAKQMAVDTRERWEEAREAGELDQLMMSSQRHQCPVQSGVKGVYYDTARKGWRVVVTLNCRQMSKFFLASKFGNAEAKRLAIECRQMWLDAIQNGRADDVFEKARKLVSFKTKGVNNGANANAGHNGACAGAAGGLPHTAPVGSSSAVCGAAGPHAPAAGGLLASRFAASGPGSAGSPHQGVGAGVGGELSHSSSVLLAAAGGGAAGAPGGLQGPSSGLLNSSLSSCLGKFGATPPGTGLSADGTSSSCLFSNAAGTPSRNLRDASNELLLAAAAANASSAHAGTAALLSGLPGGAVGVPVGAGAGPNGAVSGDGTSSLAAAAAAFLSPSSLTSVPRGLRGDTPASRGNTPGGSPTEESGGGPQAGAAGVHPAGTTPGGRPSPAFGLASFAAAAGAPGAGACATEGGAAGSGAAGNAAGAALLAVASQQGFDPKLLQQQQLAEQQLVLQQWGEAAAAVAGGVGIPQTLFSSGCADGENANGTMRDPVAAANQHQQLQLQLLQELNRGASLPPLLDVLWGPSVAGTGAVAAPGDREAGGNQGTEGACGAENDLVTLQPGAAREEAAGGNQSSLLAMGLGGQEESGATGEGAGAQNGCGLSAPVLSLLLQQQGLHHQQLAAAAAAAARGCAPQPGAGALCGFNRDGNMVVLGNPVAGGAPGCLLSGAASGDSAATDKRGPNQVGGALGNAMGAMSGHLAGGTLLGAAGAARPGANVAAPATGATGSKRRRTQQGAAAVGLQGHTGGPGAAGSGATGVGGSKRHQRQSKDAVSSGILAGSGGSAVPGADCAGAKPLGAAAVGTGSENSTCDVRGVYLDTRNNAWAATMGVHGRNVKKSFAVAKHGYETALQLAIHARRQLERIYWGSSPGDEQDAALLGLSNRGNAGAVAGAAANSTPAAGALSSLASPHQGAPASAVPQPLLHAQQPLPALQGLCWPTPGGITQAGAPGVCGRPEDEMTASMAALRGAILDPAALSRLSGEDAASAEAAARTAVAAGSLLYGTPFGSALPTGLAASPVVAPPSNSAEGTGELASSGDLRGVVGGARVRTGGVAATEESQEGAGVARPGAVAGMLAGGAGDNLSPALGMAGATAGACSGGLPGGPTLLGSGLEGRDASLNMANLIASTSGSSPSGGLFVRDALAALLLQLDPQQRMALLQGDMNSLNSLQAAFLQNSQFFTPSCAPDANQLFVGANATPNGPLGAAAPEPCSPSLLLGNAEGSAGVGCGAVGLAAGVTEETLREKEAMLAAGGDQGVGQVKASGASENEQKEEQEGRAATDLKEGAFSFGAGKEEIQGAKTEEDAGKEKEPSGEALNLGSIPTGNTAVTPVEPTGVEMAEQQPTAAEAGDGLNGGVEAGEDAKGSEAGKPETIQTAPPAQEQ

SEQ ID NO: 514 - protein, 277 aa, Neospora caninum
MEYQQEGWQQHEVADQFPNGLQQPGGDQAAQQYGQADSQFVQHTSDDHQQHHHSQTHYTVDDADCSTDDGDRTLSYMRKGTYVGEGKDYWPAAYSGHPGDQAGGFTQLRRHSAAEGGRPRIRSILKNRASVDEEPRPKKLSISFAPDQAESDAAAHPIFAGWRNRSFVFSEEKNGYVDLMNTNGQPEDIVRLDRNASVNRTIVDEIQDKLRARKLSTISVLWERYKSHGNMGDKAEGWAPNMGMPRVAMSHLPARYHVKYPGGAPRPTTCGTCSFCA

SEQ ID NO: 515 - protein, 2592 aa, Neospora caninum
MARSFPVVRPVSVSLFLLLVGPCLAVGGEHGGQGFPSRLFFFPTSSVLSDASAPFSSPVFSQVNAPLEGSPETGDAVFAASDESPETRARAFVELMDAPTEERPFFSTPASASASIKIKPHGISWDRVGTSNAQPWSPLEGEAKVRAVVAPLSALQMEQVFSTVRKKDRKIIIKTLKALTRRSFQKGDNYITTYTYIGHLTRANPLFRSVARSDEEKRRLLSALSRIISHKPHRKLKKRKEELFRAMTVVRNYLRIPKVVQNTDPFLLECTAHLVEDIRQNRHEGYWSFFDGLRHDASLALYSVVAGTFLEYQGGFDSYMVDQTNIIDTCVKMSLSVGKLPFFDALQLPGGFIGSLLAVTLKGYNYMFFPAIAATTSLISVATGLICLTQLPPILFNAYDVVARSFKKGLRLGFMKYYQFRVRGDRVGQNALSFLAMNKGASLLAILWQLKNVNYGSLKDFKTIAPTTYEAFFHHGVNFGAVEFSSEIQRHLEEDYLALRPELDTCYGSARLTPLVELKCDASWQDVERFTKAMGGMLAYVSRFNFKNYVGELLLVMYTIAIVNMNVSRGDGDNSTKAGFADAKEYIDVETSTGAFPAKLFRLPFLRENAHRLSVGLSKLDLENRLEEALSLDAKSEASTEVPDSPSAAAARSGLSSPLSAPVSARGPADAPPSFLSTATEDSLGVSSLPDSADVARQVAAEMRERFTLAPDWRGADWDGPVDALSPGEQKRLVAVRKKRTRMMFLLFHQGVSSLTVATEQLFGRFVHLLMLNNAGKPLKRCPSGPALATAGVCQNDRALRARNEMPLRLLVSIFAGMFYRRAEGHFGATKEEIVDGFLAFIEDMKFSRMPTGFFAKLRKTQPQWILDVVLSPLFGEGTHNKVPIKPGEMAILKAIVVSEVGALFEQVADSARFKHSRCDTTGQVFILTDMNGGTQFFATPTPRTAELEEAACKIEFQVQETGIVFRGDLVKGGVLLLPGVPPIAGKLSKDHELQTPAEADSETLLVVEGTLWLQGYPRIHARMIGAVLYVAKRLRYPTLSWGELVQVVTPQDLEFAYRILQEGTSEKLQADLADLDKKTLYSFDFSLGNIWSILLGTLERAVLPIKKQAFLSADFNIIVGAALLLNVYNSILKNVSGLTHWYLRFENCFYSELKRAKLERRPAPAGPAFVEAGGDAGRAGPIEAGRGTETQHASLSSRLSASFSETHRSDAFFSPSESGARGTTHMQSPFSFVGNAALRAERTGQETGELEAGHAKRSGEERENPFSFSFETERVLDWNCNAFYENGEEERPITGVANISVDERNALQCSLLQFMRRQPTVSEEDAIKLRKESGKVLAYIRRIVYELRVLKGRSRSSWKSFMNAYPAQPKNPVTEIREDVGRLKAFFRRTGRKLNTRFKAWRHKLRSELGKKFFGKRALNVMRGKRFMRVLFVAFTELFPNPAEFPGQVLLTPMQMLQFCGLQTVLRTYTAPYLFDKRKGNGLALQMKASPVPSDAHRNALEELQLRLARIVHSDPTAEKLHASQLVRQVGGYLQLLAETSFTGVEVPEYTARTFVRYVKLKMNMERRGVPKTDTEFMAVLQMQVTDLSLLRAILAAFDDVEELKKIQQELTKENYNVAALSAEKLRLYSPFFYFDHSSESGESVRRSRRPASMLVLTLECRQQTLSPSWKSGGSSLEAFLLFLRENLFPEDIAEIAWSELSTAEPSASRSSPTEEAGATDPVEDGPNAEGASTEPWKIAMKLPLLTGLEILGCASEFRPDSSGNIFAVPSVLCHISEPADYVLPLGLPEWIKLRRDSSTEADLFREERREYRDEMSMFDTDASASVSTVSAPLSPPLRADQTRMNELLTSMETPSADWGSGGDGDPTATVGSDESGGFVEERAKVEPVRREKSKDETKAERRLQPGEAPPVSSAGGDTAEPSGDTRPSVQSPTDLQRPAASAGSPAGFYARNLSRGAAGDRPVPRLPSSPTLEKAERSGLSGPSPSLPETAGEGLSVEPSGDEAVEEGEDAAATAEEDGDETEPFLDGDGDDGTGSDSGLRRAYALSDEILPVFLDAFHGLYALARPWSLREPFLRRVAQFFSAAYEACLLEGEAADSGESCRKKPAGSPSASELEVLFHRVSGGQTKPSVTRNPILEVVFKELYNNVVETRKAVTNENVGKLATWVCVNSAREICAAGSLATNAPLASHEYRSCVQDIEARCREPDWQEFQVVLQAEEQAVKSGIFVSAMQSVERQNLRQILDAIDDVLADMVVDELKKHWWAPPPFSASSVPSVAGHPLSAADGEAVQQRWRSVKKRFRKCVHKLRFRQPDLASQTVRTVVESLFFKLTRGDFSSKGELKSYLQEMRFTIARAAAVELDGTMVSRTVALRHQARSRQMRRRKRKRFYHHVPRTDYDDRVLLISDSSPSASPEAREEAPEPEASLLQVRDDRLDDGSRNAGTPLAVSPVSPSLVARRAVSPVSSPSHASPVAVATTKKGRETLEPPAGANSLTEPQRTRGVSASFASLVSRQEGNDRQGGNEAAAGNPADLSAVKNTFGYRIDSSTFNQYTLQVSARREGRLKWFRAYRINCALLTLEILVKIRSGKLK

SEQ ID NO: 516 - protein, 555 aa, Neospora caninum
MGVGTRSLRSLPGELALAGLRARADALFRSVTASNLSARKYHSVASRASRHFRRPSRVPVAAKAHYVSVPALCQISAASSGRRGADDKRTGSNSRAHNSYGSRQEGNDKRYFSFAAAGLGSVLLYGVPVDGERRRATPSLEKTEKVHSPASTNTPSSSLPLSSGLSFSSGSQFLLFSRGFNQLALCQTAAPLPKDEKEQMQQGSRPADDHEESSHHDSPLWRSEENRPFDRKLGDALLFCGNSNEPLARAVADRLSTKLGKAVVKRFADGEVNIQFADSLRGKDVYIIQPTSTPVNEHLVELLLMISTCRRASAKKITAVIPYYGYARQDRKLSSRVPISAADVARMIEAMGVDRVVAVDLHCGQIQGFFGPRVPVDNLEAQIIGLEYFHHKDLHKPVVVSPDAGGVYRARKFQEGLIARGYTDCGIAMLIKQRLRANEIERMDLVGSVAGSDVIIVDDMIDTAGTLCEAARELRKKGARRVFAFATHGLFSGPAIERIEASPLEEVVVTDSIKARAEVAKCPRITSLSISVLLADAIRRIHQKESLNDLFNVKY

SEQ ID NO: 517 - protein, 420 aa, Neospora caninum
MHASAALAKAFRPLPRRPASSLSRLASCASSTPALGAGVARGLELTDLKTRDAPKSFLQQRRFLSNAKKPAYRIIDHEYDAIVVGAGGAGLRAAFGLASAGIKTACLSKLFPTRSHTVAAQGGINAALGNMTEDAIQHMCREAPKVVRELESYGLPFSRTEDGRIYQRAFGGQSLKFGKGGQAYRCAAAADRTGHAMLHSLYGQSLAHDCKFFVEYFALDLIMSGQDDERKCHGVIAMCMEDGSIHRFAAKHTVLATGGYGRAYQSCTSAHTCTGDGGGMVSRAGLPLEDLEFVQFHPTGIFPAGCLITEGCRGEGGILRNGQGEAFMARYAPTAKDLASRDVVSRSMTIEIREGRGCGPNRDHIHLDLTHLPPATLHERLPGITETAKIFAGAFFERNYAFSTVPNAALFSRILCLLME

SEQ ID NO: 518 - protein, 7289 aa, Neospora caninum
MLETGTRSGTSAHEQRTACGSGMFLSSETDDASGETQQTVKIDESMNCWNICAFVEDLVYDTCAKDASPVNCMSSALKTNSLIPDAYKASCSYSSPETTSPRFWDAEPDSQFCLDKGMYAWLSSTSWDEFVSKKPKECLYPKQDPTTQEPPPTAYVNDAMSGFGEALGSLTPVEFYVVVRGAEEAMKNPVEYGAYLASSIVPKDYWEQAAADAKEGWLVARAFAVPDNLSDFAMLTTAEDGTSTSAHICLYAVVETSNYSDGTRKTFTNYGMIAQSNTCEGQIGVLPVADIRGSGIFDSSAQEISRKTGFNLCVARRWVTSQSEDNGVQVTSQRPMFHVGLDAPCASFVAAYSYTDQVPAHGGQWEQYFVAKTYPLTRGIYGLPDSARCPWASAVQYGLKCYASVEEDLFMYIGSFAEAQLTCRRLVSDLRVPSDFSRVAVMQSDDDAKIMNFLSEPDTFSWVGLFQGTQALLPVKSASLDSSRLPEQSCPAAVLEEEQSAHRHSDIEQKCLKAGADISSPPWTTTWVGLDGSAKIAPYVRSSWHAGREAGQDGIEGLMGGGRGRGTLGSLCQRLSPDTAGVDFVRRWDIKWCSGHPQTEKDNRYVDCAGLRVFDDMQACIESAPCDEANPVFCTYPVDYGPYLVATSANAEGSGGTLRLPPSVRCRLGEACVLQFSLTQPGTSSETTLPGSSGTIWGLPPEGGFVAIKASCAAVDGAMLGPVAISSEVDLASLAGFSSASVGLYELCYCNANAPVVTQAANGVAVNTRCSHESEFNQMVASLALAINSESVGFRQAVELPARAVSVSTRAVLSLVGREAWGGVPTLFCGWEGATKSCPFEVHVTSNGSWKSRPFTTKLRFVPAANDDPSTSWCSADASEISVSVTVEAGDSAKAVFPGESATALFYAVCEGKKFIGYVVLKEVIKAVSAAVALDSVQLSVQSTVTDDDVTLVLRGEFTNNLLLRSKVVAVSVDSLTDTDCSSGSLANLPESSVTIVPFPALSAATDYLIELHFKAGPSAKKLCWIESVALGDSRPSHNFSTYLTTFPRASDVQTLSLEDSRCFVAPGDQPCSFRVTAEPLPSEENPINASPYLPSTFRVYVMEEACPSNSQDPVFDEIDNASYDESAGANMKGFPLELQGESDASLRALLQQRFFPWLQARGSAHFCWVYTRGDAAAACPNDSPPCGGSLGKIYAVGAVADDASNVLVCLPDDPEPCLATVNGVNLNLYETASNRMAALERCGSDTGIGLLTPWGPYSPLVSSSLSAVEIRVLQAQSGSRLASQARPASSGLHDQPSMGRGSDLKAAAQAHAFQGSDGRGELQRSIWSFVADGDVTDPSAGVPAANSTRLVFQVPFSSEGAGFDLCFRSGESDSEDLTRFTETVGHVLFAWRLYSATLDAEITSNPMALWYRVDALSGIDLAHTYASVVVYLKPVDGYPADTAVPCDYEQDTSGDAALQIQGPVQPFEATGESVPGEPSLEGTLGSFKLQVTHTKTMAVCWSQLLQKASQPNGSTSKNPISAQSATLLGYVAGPSLPDTGDAPAVAVSCALATSQCRVTVVPVPATVPYTGGLAPAVPAFLDVAVTVLLDTELNQAPCPEPTDPAYNEARRATSKTRRVLPGDVLTPERQTFLIDSAAGELLKSTGKAGICYRIDRCAAESDASTSKCTQFLGLALWVGPTVETPERVTVCKTEDRQCVFDIDGLNMDAVDYSTARAAYSTACGGPGEYVYAKVKNSGATSTRDTNSDAVPDEVPQQGTALSAKTFAVDIQPASLWKLCWNPFEASGLEVEELDEDRFVVSRGFLVFPARPTVASRRVEQDSQGQAALDLVVSAMVTEAALEQISGPDAPVTQHSIYVSPLESVSDGASEDVACADSDQETEIHWSSVEPSTPTTSGAQASDIHYSILRVSIERKVCWKSIFRDATGKVIYEERIYLTTVPAVLAPELDNTVATQPEADLVLCSLGDEEMCLVTLKPKASTDPTDTATFAPGGELYVVNGFDCPSVRSDPRFQNAAADVPTTAAEAVLLHVVTSEASKKTLSFPLDDRTWMSSRQAAVLCYIFDSSQCTMPDGCVEKIGAMFWRGPRISEDTQLRIFCNDSQGCDINVTGLNLNTFDLSYSRVAALDACGKPGGLGRLEIVTYPDGYVQASPVEPLEDYFSADDRLEQGAFAVNRMGRGLLTCGASETVSVKTASWGLANRQPTAVTCAPLDVAAQVAAHCKGKHICVMYPHSPEDDAAVESYTGLNRDEFLRLDDPCPESGRDTLTLVGTHECVPGDSRAESAALVEMSSRALEGADSVHPSTKPMQMSLKLPPDVAKLYELCWNPDQVITLQPTRYSVKLGVAQIVPTAGMVDLISTVFKRIDDANVEVGVKGILSEEAAVQTSIYLKDIPKNGAISCSNDDPDEAIAKSTYMSYESGDSGTAVILYRIAAVNTEKAVCWRWASDEFASDGGGLQSIFVGTLPGAVNPRPRDWGEMMCGLPGGAECSIEFEPDKLLNTYPAEPQVDDPGAVTGFTDYSRFTNLHGHLQSAALVGLIAGRETCPDDRQDLAYQRFSQTANVGEDLPDSAIQETTLGLPISGGGPAALASTLSTGHLHWLAVHRDAVVCWVNERDCTTDQAPRIVKCTATVGTLSWKGPVPTAWSASLLQLMCRTGAPCRLKIPGHNLFKLDLSQSPVAVVRTCGGDDGPGIAQIEQTPTLYPGGEAAQSEESGALLQTSMSLSSKRRRTVRQFGRSGKRGGRKHADKCDARSSTGKTTVGLVARDRGHFSALEALTGSWRTPSSSVDDTLEVLTTIKSGGAYAICWNPSASSTSLADFTIKVGEVFSYGVEAINALCYSGSYCEVNFTYIGNSNPTLFIGVKAVDCSDPDLTTELGSGGVFRNTKRNTIILSEPIPSRPESSRVSYKLCWCDATDVKDCVGTAYTVPVGTLSVQFVEEKAVACQESFGPCRISFDASDFDGDASGGMFLTEYSGTDADCTQSRRYIPDVVEEAGKLVVQVNQENLATALGHAADNGAFAICRQIKGAVPEDTEGPPASDHDGGNSATPGSEQNAGGNNEEQGSHQSGGGAPEQESPPAAGEDRADSDAGHGTGEDTTGNGAPGVGDAADKGSENGVGGDAAGPGAEPSGQADPTASQSTNLEAKAPTSALVQLDGSADSGGSQQVTLSPARLGVLQFAGPLGAERQDATQAAVLGKPTRITVTTQGFSRFIGTDVTVSRPDMPASLANVRLVPTGGCGRDNGSNTVPLTLSDVTNGARDITENAVYEQGSILHVNVGSLRQLDVCWCNLETACNDDADFSVPVVTVALVAPQQDLAVECACGSRCPFEFEGVAADPKHDLEPDYFVREDECSVRPAGLPDTGHLITVDMASARAKGVGGGSETDSDQSSAGTPATSNTQIKAFKEVVSRSPLFPSELELKSKAFSICYCASKSGGCATDALIKIGTLTIYDVWMGPMTAILADDVTITPPKPPFHGVQGTVYADAGELRLPVKADSDMAYAVDLSPLGNEESPASVVAVHYCESEVTQGCEAAGAPRIDLTQIVLRGPASPSVEVECVLGQKCAVFTKVFNPAEEDRLAALESCGSSTGRNYGISNGVTPGAKDLAKAVDVTFGWEETLPDIGRADLDLCWCKKTDEVDCSTVSQYTFKVGTLNISGLAAGQEVTCHVGAVCDAHLQGYRLREDVTNVRVVSGACGTGGEVSGLPNGGVLEPQEVDASSAHVTSKQPFFGMAPEAAAICQCPLPSSSCTSPADFAWNAGTFTFEGPSERVVSYAFSGNAVNVELEWRGEQQAASDFFILTQDTKCTGQTSGLIDGFRQNGLGRLNNAHVSWETFPYKGGIHSVCYCRRSTPLQNGASDPFRAEGGSTAQHLCSTVAEYRVPVAVVLVTGPVTSSAVFACFVGAECLIDISVAGLDSSDNQDFLKSATVYVTQESCDAEAAMEATLSKAYGASGTLDDASANVQMKTFNQTFRFTTAVSIAAGYYVACWKPASASSAILLGDFVVKGPLVEEAAWESSSGQDVDVGLTYAGLEGSKEASEMRIRVYPIPAGEEKDTFNCAAPDPTESRPYLRFTNLDRAPDAVESVSMQFSRIVWRSVSIVIDDKTPDLTPGAYFAVCFCNGNRGDCAEARSYFFQLNTWVVGGLSQRTVEESVPVGRTVTLTLSGKRLPLRNHLMMLSQTDPTTLAERHCGDDVSPQDVQIVSATRPTHVTDWVAFKDFTVASSTRTTLLCWCGGDACETGNMFRTFVGKVSVEYPTFEATTAVIGGTFSITLRGSMLRSLDAITVVDQHTQCGAEGTDAMDASVVEVPAGLPFADLATLRTARVVHADSASSGSLTAASDATSLFWQSWPIKTKASVSGHLRVCYCSSEEGVCSGAGRFSIWVGSVQVRGPSTGDVDVVQVEGQQKIEATGVGLALTDKLKIFPRSLAVADSVSDNRALCESGGLESTTLTADYVSPDGTTETFPADLQPGYRYVLCWSAGTTAPSANARLRRLALKRTKPSASTPSSTAAEGETSPSTLQLGAEEAAAALNLLKQAGRAESTAAARAAAADNGETSTETGSKWNYLDAFTPKGFRSGLDFRLVQNFDDEVLYIPGSPDLTHAYVAYLGQQDSAGDCESIKQDPLATFKTMFRLQDDSVSFKVGSMTVAGRYPVCLCDSTADECYDVGTASVEESYWKTVAELVYDNRFFMLPCVSRGEPETTEDQTGWSEDRVWLPDGMGVWSFILTTTGSQSLHPMPVLKRTRPTGSKAATWVNFYAKGLRSTVACATDRKQRLYFLGPGRVYMMEPVPGLSPNLSTATGKTFTHSVLKPVDFSIREPYIFFSDYESQVITTINIENPELTHAFYPTDPVMLFSAGVTVLDVDQDYMALCVADTFNHIVGRLNISFETMKTRQTAVKAVPWTSYFGTPKTAQHGINGFSYPFALANYSPQSASAGDLASLLLVTELVSDRLVFLDLKNNGLSFYKQISLSERHLISGLRSIDKTVLLISRAWPPTATSGGMDAYVALLNLQDVGGNLYFTYPDFRSKLQSGLFYSFEPLITGSTIQSFREAPGSDLATMGLTLDSATGVIKGTVSHTGSFNIAVTGGDLLETYTWSISGEAGCRSGEYFDSVKNACELCPVGTFRDQETSLQNCHDIKPYSTTLSPGSTQLAQCRCLPGFEIGNLGDCHPCTSGTYKSSISDTKCTGRCPGNMHSYIQGAESEEALLCLCDAGYYADESGCKPCQQGSYCTGEYDPPKPCPENHTTKAGASKSIGDCVCVAGYTKQGDKCVECDRLSYKGTTGNDACTACPQPAAKGDRGALIASTKLDEAQFTNKPGAKKVSDCVLCASGFFYDVTNGGCTPCRKNYYCPGKNTEPRGCVENATTLREGAESTFDCRCPKGHGGSVARNPLDKAIVCVGCPKNTFQHLDGIMTGCLPCPPFTMTKTTKSTSFSACVARPGFYLSSRLADIMRGFAGARALDGVVGEDLDEEEESKSNVTVMSASSPTLESVRQAETKYENMSDEDLLEVPRVCQHGTEIVKLLLPEIKMQKYTSSFEQCIVACARNVYCTSLTYTNGGSDVPAMTATVTNHTGTFIIAYSICELHMYGPDIDAVTAASITDRFTGTTVPASMTVSCALRRPQSDTVWRAVTYEECPANAYCPGSDEAQIYQCPSSSVTIATRASTAEHCKCIPGYYLSGRQCEPCKMGTYKNTTDNAACTDCPAGFTTGNMASISAYDCACIPGLYMIANPDTDTNDEALAPPSDGTNSAGGEPGETEPKPDADGSESDTGGEPAAEHPGRAEPVPNASAGEAADSEAEGGSGTEPVSAVQLLGGRLVRGDRGELQKALKASQDFASIRSAFQRGDAIGEEQGLSFYQTSKAAWLAPDIRHELEKVVSLHQCVSCYKHMYCPGLWMDPPMNQTHMPPQLCPEGSAVPLSTALSDSVEKCLCLSGYASVGTSVGGAGDASVAFGCVKCASGTYKELQENAPCAGRCMRDAETIEGAVAKVQCFCKIGKYAIVAEDSEAIITCQDCIPGGVCPGGLKTLARQAVEEDHNFVQITIYDHQVPFPSNGFYAVYKPLNQTVWDPSMVPMVPSFTGDTFEEFTSGVSESASENDSETAGGLDLVDESTEGSDETSGVVSPESAGGQGGELSEISGAVSTLQVRTRENTEAVHRYDRIPDIHPCVDDVRCRGGSHNSCVEGSAGYLCSACEDGYSQIRYKSGCYACLALWLDSLLFILMRLVVCAIIWVITALSNIAVQQQACIHPVLIRIAMSHMFFLSVYGLMPATSQSELSSWASIYRVFFFDFYFSTHPYSKVSCFFRHLGIVLSDTHQWYWQRFFQIFVPFFDAVFLTVLGALCVAAYKVVYSGYIARVRVVLQEAREAHGDDIWTERTIRKIESERCLGMFRYISTTSSPFESFVRLLTDLVPAYTALWLWHFPSFVVECTMLMGCVETRYKMEDPIKVLAAFPVQVCSLEDPYFLAGLSLGGVGLLVWGVGSIAGFVAYMSRDHSSDTIDQRFKHGFLVNGYQYEYRWWEGLIGLRKTCVALIMTMYVHTNSSGAQEIFRNSANLALTVLSTALQLQLEPFDKRSHNMANRMEFYGLMVNIVIGIIIQGSYYFDAFKYMGGAPLAVATFYYLYVLWSLFVEWGRMVMMRPYLVSIPSFWRYYNRVTRSLARLYTSGNAKIYYNYITKDMVLEAATKSRVFHLRRLLLRRKKTSYRKINYENRTYFVAALSDSLSQLVIAWCQFTIPGDWLDFTIRYAFCYCFWQRYQDTRSLRVPLDLEEFEAVKPTLFSDWYYDSEKHDQQGDGELDFGMEFLDGADITFNTAEQDFLDLMLDDDVYDDSPITLMELYVAVQSMQHVPQRQLRRLHMAYRERMTQAADSTAPQLRKENHALEGELEELNRALQEMAGADDKIPDLTFSPLDFFFTVEMVNQAQHEIERLRGLIESEIDDIARARAAQAVAVHLELSLNENADVDELLETMAFEEQTAKEEAAARIAYVDESKKRIQKKKAALAGRRPHLALAAKRPPLNLEDKRRLRLGPAAEAGPAAQRKIGLVVPGAAPVAAKRRISRHTVDMHRTLQGVAEGAAPVGVLRPDRQVPRGASGDQLEGTRRTIRLGPGPSTDSPYGNKRTLRRDMTGSSSDVGGEPATEPKRVARTVSPLRSRDASVGESAEGDAEKAEPPTSSSGAVGTVRSVLRPEPPGPTESPLRRDSELSASPSPSSSPSPEPREKQGPELAGRRRLGPLGGSRPPPQDAEAPPPAASSSPLAAQPKGQGLPLGKRQLKRPGNAKQD

SEQ ID NO: 519 - protein, 139 aa, Neospora caninum
MSPPAAASGAAAVLSKDIARSFRWMQAFAAVKGKPTAGSCAAGTAVVNPEEPGKVTLKGRYTNFSLQHIWEKYDYLQTHLLLRECLLSQVAKNPRLMDPEINAGLTPTVFMRVPSAGTPQGAASAEPQPKATQNAGKTN

SEQ ID NO: 520 - protein, 239 aa, Neospora caninum
MAGPLLRITPEKVIEFPVVLFSSSTVELHLENTADTFVAFKIKTTAPKSYLVRPSTGIIPRGGKEVVHIVLQPLSEEPTRPCSDRFLIQSTAVSSDAPLARDYWQTLDRDRIEDTRLSVVYRTSSSSGDHVGGAMGAADGNGPSSGRGGYGGASSSQGGSYSADLKSRYDQLVEYALALERHKDELVKENEALKAQIGRKGAAQKSGGMGVFELWHIPVYIFIGVVIWYFFGRSAEVTK

SEQ ID NO: 521 - protein, 353 aa, Neospora caninum
MFGGDKGGPGGGGGGRIYIGSLPGEYTEKDVEREFEKFGKIVKLEFKRTVSGAGYCFLEYADPRDARDAIAQLHGRPPPGFRDAAPLRVEIPLARSGRTDGFSDDAMPRGLAGRRGRFVLEVRGLPPSGSWQDLKDHFRGIGDVGFAEVRKDPDAPDSVMGKVSFFSKRDMMEAIEALDGSTFRSHEGEKSRITVREKRTVGGRGGRSDDAYDAAAYDADPRVGGRGAKYGSLYESSNGGYSSGGTDAYRASVDVVHESAGRGRAGGPGTGGYYGYHPAGSPSPCRGAHPAYTEHRRGRSRSRDRVPPARGGGYGADGPPSGYYDGVGTSPRCPRLSLERGSRRYDDWADRRR

SEQ ID NO: 522 - protein, 319 aa, Neospora caninum
MTSFCSASSAASGPRRSKENTFSRACLRERGVAIRAVVTDLDGTLLNSVHAVSQANVEACARLRRKGIACVFATGRPHVGTVKCLGSTVLEEMGMANAFPGVYMNGCIVYDPDGTLLHAEYLDKDAQKAVFSLLEERNLVNRVCGYQEQGIFCNEKNKYTWHTKDEYDECEPVVVPSLDELKNMNFCKLTVNGSPEEVAEFRILLESVAEIWDGRCVQPIPGNVEFIPKTISKAKGLDILFDNMNIKKEEAIALGDSENDLEMLRHIDLSVCVANGCPSAKEAARFVTVSNDQDGFAVVVQEICHELEEQEARAARGAA

SEQ ID NO: 523 - protein, 535 aa, Neospora caninum
MQIFVKTLTGKTITLDVEPSDTIENVKAKIQDKEGIPPDQQRLIFAGKQLEDGRTLSDYNIQKESTLHLVLRLRGGMQIFVKTLTGKTITLDVEPSDTIENVKAKIQDKEGIPPDQQRLIFAGKQLEDGRTLSDYNIQKESTLHLVLRLRGGMQIFVKTLTGKTITLDVEPSDTIENVKAKIQDKEGIPPDQQRLIFAGKQLEDGRTLSDYNIQKESTLHLVLRLRGGMQIFVKTLTGKTITLDVEPSDTIENVKAKIQDKEGIPPDQQRLIFAGKQLEDGRTLSDYNIQKESTLHLVLRLRGGMQIFVKTLTGKTITLDVEPSDTIENVKAKIQDKEGIPPDQQRLIFAGKQLEDGRTLSDYNIQKESTLHLVLRLRGGMQIFVKTLTGKTITLDVEPSDTIENVKAKIQDKEGIPPDQQRLIFAGKQLEDGRTLSDYNIQKESTLHLVLRLRGGMQIFVKTLTGKTITLDVEPSDTIENVKAKIQDKEGIPPDQQRLIFAGKQLEDGRTLSDYNIQKESTLHLVLRLRGGASR

SEQ ID NO: 524 - protein, 2231 aa, Neospora caninum
MKAPSRSSLPLLFLLSFLPFTSLFSEAISRASASHTLRDSAAHALHADNDLARSFLSRSEERSPDARSSLEEEADAVENASSHLPDLEDALQQELESASSSPETVPLSSSEGASDPSPSSFVSSSPTSRASAASASSREAPDSLPTLAEVHASLASRIAQERSSRRLSDAEHGEDANDENGDRKHVRKPPRDKSAYSVFSVPSLRLEGVAIADKEEATASFAISVGCGFFHDPPAIPGIAHQLEHLIFLGAEGETNATSWDEFVSARGGTHNAHTTAELTTFFVAAPTDTLPELLDRFLQHLFRPLLAADQFASEVMAVQFEHEKNQPDIARVLLELAMAATPAVGSPTSTSREDLPPSFYRPEVAQKFGTGDYETLCQAPIEQGLDVLKALRAFHRKCYRPENMTIAVRMGRRSVPVVIEGSFDSAGRPRPIPAEVQAEAERQAEKYSVYTPKEIGEVVARILTKYFPPTEEAESDAHRADNEDAGASPSDPPSASLTPRPHKASSSASSASRSGAKAKASTTADAKRRKAVLKTVRLHAEEKEKTGAQDAASFLEVTPEEHASTLEDDTELAEEDSIQADATSSTSTGKVYRVFRQHGWGKRLLLVWERRTSWAVRGFDEEFQPTALLEYLLEYPGETALLNRLKVQGLIADGEYVDYTTSQKAFIGLLFELTDEGEKNHEQVIAATLAYADTLRTSVDDAYILDFFEEFAGVANRSWTYKDPEDAVSAVIGAAEKLAVFPQRPDLVVAGGEYVALPEDRSVLVRVLREELQSFDSSRASAFVILPEGRARDAGQDVHVFAPYAVQYTVTELPAPEVARQVGAKIGRSAAEKLEAVREAAESVQLRTQSLVSVQETVFSLPPVLSCKLAAEVKLQRRPVPDVCQSLSPIQFPIQAERNEGEGAAKRAGFSTGARAGVRDADAEDDDNEQKKLEASGPPCVLVTEESFSVFWKNAEPFNKPVVRAYFKLRISAEDATGKNTLYGKIFTTIAGERARTALATFEGCGVDLLMSFTNGALVLEIQARKETFRAFSELFASVLQQLIAVLKETRESVKEADFTKVFNTLELQLSDFSAVTPFEMAMDVALSVIRRNRFSQLDLRRAATESSSASQFEEFQNFVRNALTRNALDVFIMGDIDYDAARELAEEFRAALSEQPLPFAQSAGNEILNVAEDIEIRFPNPIPEDATNAYVSLYVTHPPPDMMEMVIYSLIGEVISSPFFDTIRTHWMDGYVAAAAVREVPPAMTLATIVQGSKRKPDELERHVCAFLAEMQDNIGTSMTTETFLERLRWLSSSKFHRSATSFSDYFGEVTSQIASRNFCFIREQLARLATEQFLNCPAILKHYMNALVDRANRKRIAVKIEGNTPSAEAASGSTRATENQPLSSAALPSRCSLPSLSSSASASAEVRQSPSLSTLTPAVVPRAVAKHDGRSQRETETSESSSSSANVKGQAKTGDQTRTSSASSLGSSHKDGAEAEHLAGRVVSLLGVGEESRGAKAPVNERRSYGSLLGSHNVFKSNRIKTDFASPIFTLGDDEEALSLIQVDARISTQSEHAKPVLGSRKAEGHSQAPSAAVAEPSASKNRKGRSQEPTETPGLEITEIVSDVEGQAEEGDVPIEFLPLAKQIMPHILERCEEDQKAAADGKRIVVDNFFTDPDEARRVILEKLGAKLNSSGSAPPTAAAASPLWLSYTRAESCSIRTSTIAKAEEVCGSIREAEMDAVPLVSPEQPSVGQPSIPPTLAAVPPTSEEAPPSAAAAGAAGAAQEPDQAARAADLEDASAAETEELRLRQSAKQRRLEQEKSLLEARLTRLELQTIAQRAQLLKQRLDAMKQYGTRPTTIFNTWLAPQRRGIRDVGGGKGASSGAFPVAAVSALGATTHGLPSPQGVQGRLRSPSSLHHAADPLAFKRTLDTLRWREQALLQRQAELRNQLRAEPPSNASTPASTVPSWGAAPGQAIRPVEYVAAPAVASVPSSPYLGSSSRTIAANQAISVPATTAPNAPPAVAASPVAASPAVAASPVAASPVAVAAVPQIPEQVPGLGVGVAAPGLSSVSGVSAAPSPALAAPVSAAAPVPAAAPVPAAAPVSAAAPVPAAAPVSAAAPVSAAAPVSAAAPVSAAAPVSAPSPALAAPVSAAAPLALSPAFQAGLAATAPAGGELSESPLVQATVSGVPRVVAAAANFQAPAAQPAVASQPPSPQAVSPGAPAPVAAGASATPAVIQPTAPVAAA

SEQ ID NO: 525 - protein, 515 aa, Neospora caninum
MASLVCAISGVIPEEPVFSVKTGLIYEKRLIKKHLETSGVCPVTSQSLSEDDLSDVKCPKAARPRPVTAASIPGLLSLFQSEWDATMTEVFALKQHLETARQQLSQSLYQQDAATRVISRLLRERDASRQQVHALQQQLLQAQKRAAASGAGGDADEEPGLSEELVQQMQALAKQLLVARKKRQIDDVLPASRAASFKCIYSLPLHSSADRGVLCCEFDPKNPKSVTATGGYDGNVILFDLEKQKTLYKLTGHTKAVRSTKLHVSEPVVISASDDKTVRIWRASGDGPYKTAATIRKHRGEVTCLSLHPLGNYFASCAADKSWAFSDIQDGRCLQMQRNLSCQYKCVSFHPDGMILGGGGVDGSVHIWDMKGLAYRAALKGHGGPINQLAFSENGYYLATASSDGTVRLWDLRKSLSFQTIDMNEANPGEGDKQKLEAACVTFDKSGQYIACGATNNAIALYHFEARAAAANVINLLDHTDKVTDVKIGEGAAMLLSSSMDRTVRVWTPAEEDEE

SEQ ID NO: 526 - protein, 682 aa, Neospora caninum
MKVSRIWCFFAWHMVVQVSVLKETGRILVSAIRQDLQHTHAALLNGVGEPAGPEDENSWLCRISRGFEACGSRKYSENERTGMYCPEGFCCSKTACFYGSCGSWCHDNWALCSSNLIYHIEYSYGKCNCKRFQEKCDVNASCVDANRDDGGAYCQCNDGYWGDGKSCKIDFCKYKPCGAGTCTRTDDGYTCECPETHNLVVIEDKQTCKEKPDFCLAEPCGPPFMVEKCVNHDEEYECVCKQGYAARNGRCEEIDLCAESPCGSEEAVHECITEKEPKLRYRCTCKAGFDLSTLSDGISQKCVKNWCYDDPCGPRDQVESCKSKEDGYSCLCAEGSEVQETHGKEKCVRSDLCRNNPCGSEEAVKQCYSHGTSYGCLCNTGYTEVPVDGKNMCQRGDPCTLQMCGSSEAVDECTTDGSSYACTCKPRYTIAVKNGKKLCIPEKECISQCGPPEAVKSCEILDSGAYHCSCNPGYVMRYSGSVKGCAAGDQCSTNPCGAEDAVRSCIPDGQGYDCECNTGFVKRVLPDGKPICADPASCVGNPCGSSDMVEACVAGTTTYTCRCKEGYTVQLIRANSQCFPVGGTDKQKADEQERQESTGGYSTAAIAGGVVGGLALLGIVAAGISNSRNRGYANDDDSQLPPHLARPGMRPSLEAMDDRAWASSPSLVPPPGARPPSNSIWG

SEQ ID NO: 527 - protein, 4520 aa, Neospora caninum
MPIPPTGFHTRFASPLSFGDLFTSPEPGFDILLSTRWNGQFSALVQAELVGFKYGLTAPRPLRNSRAMFAGIVVERFPKQACQTLVEDLAEASMLQRPATESFGAIRGTKTVMALRRLFEKVVHTRKAVPLLEQPRINDLRVLLAKELRYLVKHGNLAWSDRLTSYYKAEELARRKLAGKFMENMQTVKEDYELRVLVRAAETSDVGIQKIFLVDVLSEFPTVLLEEDFFSSKLQDFFSSILQYPRSRVTMDREAMDALFQTHMQTKSASSESLTNDLFKHVNDPDQYFHSWAKSLFVDVLALVWNYYYEHSQGMLQILYDKKEAFDFLLEEITRLPEMTAATEVGPEGNRQSRVELAGGLLARKAFSLDAFGFGTILHLASWQATNNYGHLAVVQGTCRFAYIAVARSEVKKAASVDNSAVISTRFDATFQPPPSGIFTGTFYRTKKPFSSALYRRLKTWNKLGRPREDIRIRHLTTAMATKLRQNVLEAPEQNLQATWDFASLFGPSQANFIDSFRAAAEACFDSMFVNATSSLRPLFNIELAHLVARRSTRADETPLHPKKQALREVLRARLVVERFEATKQFSERLRTTAEDPNENVVSFRIQPKLIETILERPFFYDYDVLNSIELISSIPELSDVRLALQISIRGLLALHRLLNRSPLTLLNYKVAKWLHLYTPVGAQDSMRHSFISRLNTVMKLAWQFHSRSFDNHIDLLPATELGTIREKLIQAGLAAPAEAPRRRALYGPGVLPEAFDSSGFTTALALVAAAELKSTPIEYLDETGRLFSVTCRKCRNERESFIATSKGLVRVPSPGLPVAVLALPSTPPDHQFSGLKIWEAPRASIIAPRAPRPHHVRRILSRLQSFFGAERRVSHLTAAVTEAVIARAELPNEHNICTTLSRSFPSCLVQPILNCDAGDQICRNKIDAVSADFEDMFDRLWLEISSARFSAERLRAEAHWRLLSPALVNLVRANSPDLSPEEYRLLTTTDPQYAQSAEGRTATRMLWIRLILKQPQQLSPADFARLQIPFEEFGRGAPVPTKAIQQIANYYKEEIAAAAASDSQLGEEAESALEAATNKARKEFASLGIYEATDKRLLRKVLLDLYHLRHESLFDFLLGSLPTAEDFPPIFRSSLTACLLAEWRSELEFDRMMGELEQLSGLPALTPHTVKDCFTKATAALETESPREGEQAPALIPAQVPALANNSYFLFLTFYRFKSVLEALEMFRALRRPREREVLETVNLQQLTENVRLLTKGQFRGLLRRTPGFCEFAYALVAARTRKDLYILEAPSRRALAGRILRIGAASTGLLSTRAQRSVSVLCVPFCHVVGQNSLSSFDLVGTVAAEAKRQISERAVSLRQLVSGVVPKLAFLAQLPRSILNSAGKLLPAQNQVFVPGESSICSETESPVSWVFVVKETCAMTKVSKAYFLEALTLTLGIGQLNPLAWLRFWLAGNDVLLGLAKEVLQAKRAELNSADANNWEAFVKDPEWRRMVPAIYAEVVLRLNNSLSSFREVVKLLRWIRPATRAVKRSIASILRFFEPVREEKKQKEGAAAVKVERLPDVFFMKNWRSFSICMDNGEDGLEFSTAYRLVAAIGTSLRAAQRFPTESSLMYGSVRGERSVMAAFNRMAVDYFIGRGGVHDSAKKLIEHMLLAILHECERSASSADMAGFCESARACRGTNSKKSRMRLTEVECVMKSVQDVLASDHDPGRLHAVLNMFTGLFEELGHRVAIWSQPLNKLFTFETTVQSVADSFAIQLIVGPGGPATVEGSPPGCALYVVSPAFSLKTQLEMASHHREGAGAPTESYSAEAIEVLDLFLQEQAAAVEATHYVSSAPFDSLAAIVDRIVAHPELDSLNVLVPAQLTKVLGLNPENEELIMQQSEFIDDSLRPHVGAAVVDLEILRNLTMRQALHACTVTQRGCPNVLEELERRVSAALNICQEKAEHDLLSGVRRGQRKKLLTTIEDIRRTLSTAECDAGGCRVVSKADVAFRALSKFYAPAEFRAMYTQIFDVPIPAAATDLGENPTKSVDSVRSMLTLPQWATILTELNAGVASRVASASQGRNFDILEQIRLFKRTCFDVAQRRLRDSLAVIQMTVKRNAPSWASEIELEFEQRERHKKQIMNSVLNDCCSREKFAQQGATVAAHQLIKGLRSRGLATDWAEVFENLTDNRLSHITWMQQAVNIDVRKMGDNERGMMQSCHEEKFWKLGATACTALFLKRMRSRGFRMTRYTPVTKGELEDLKQTYEEWMDKARNVLLVEKKAGHSIMKIDRYANAEAKIWVRIAEALYARPNSTWPSVRQTIVNSGDRVYLTVLGRKKAHRLFGAVQGKCPPGTAGRTLQIWTRSLHRAVSYVKEKHFNQFGAFLVTDALVRRLREQNIFDAGNSAITIGNIKRIRTFAEWKRKVLLLKVSTEMIRTPIPVALVQSMGQHRHLVRLLKWFSKSKSMTNIIRTSVLSIARLALGPALSRIVNPWKATKAADAPDGAAGGVSAALVTGLVMSSIFLDNYFGVKLPVILLLLPPIISFVKSYSMKNLLEQIIDSIELPELATNILEPFFPRLEQFLVKCIRDYLTVDFLDGVIRQYLSSRFNLDALKLSSKIKDVAEFLVKFIRRRGPVVLTTLKRYFVSPTLQDYVRILKDFVVTVVTTGADAIANRLLYRPRKLHPALFQYIVRGPSLTDAVGLKDFYEVVLAVFRDRTLAAINPTIAIPPEVTAALTPLEKIIAFGMFPPAHAMNPLGCPSLTEKAWQTQTKKYKLDFYPTPRVAVTGFVGELRLTVLHGQREVPHLFLIKEVKGMTLSKLKKMRGVLKQQVLVFEFKRHRQVRDVGEIVVRHPVSKMQCTLSVRFGSLFAEAVQTGALVEELNKTIPGIIQHLQSISSEGLEDILTHLATHLPGIESPEALVEETRKMIERKLFTRLLQYEYLSEPNWFALDFGLTVTLPREDDAAAAAGPTSVELTVLVGEHEVAKSYLVSVFDHQTHITQLDQTVKKRCGVKPTLLQRIQGHLGLRRRTESTVRCIKIVEFSTDQSGRTWLSLSWKSDNGYVSQRFMVTPTNNPDMTKIVEQPAERPLSDENLEDLRTRIAAASAHGGNSYDLIHWAAFTVLFKNSLINASYRRQRREFRRVMSATSDSGKKVFRERDYLDSEIFGKPQASLNPAWMISLDALLRQPKYQPLVEMLGDKLHVYKEALALALSNISTAKSETLTSGAELVTAERLSQLCPQGLQETAESRDICEQNNGMWGSLWITDRGSPLLRFIGKKKMKTPALFKYWLAGGAETAAKYAVGDLDEVEQFQHSRHDDITVKIVALTVVSQQLLLQLYDNYLEAEATGRVKDTDEKYQVLKYAHISLLRLLRTYASVSGEQNASVPEVLRNAAQAVLNTVEPAAVLTAEEKYTWTSMLEAHSEQVYRDMEISFGLRELSFTLKTPAAGVADGGRPRYMVYLMTMLHQNPYVDGTGYQSSLQDPAIRQGCSASPVNCPSPEVLWNHVYTSLLVMVQLAPYPDMLEHLLSARNLDFSGRDDPLEPLNFDEAMSLFQYGVSIIAKWKVTPEVEDYFSGKVDLQWIRRMLSLFDDDETLRVLIVYTPPLHLRTTVLQNPRVVLQKATWNALVALWGFRGAFGRFVLEVRNGWKKQVEYGVPYGLATSDMDSLRMPLPVREFLETELRELMADEANPGMPVLVLESPGMKVIDNALLDLVPVFRRAGQLPVSHPLFLQLMRNVRSYLHTMRAAHGAKFAKEKLLDATVRTRFLSIIREAALKAAFMEQLQIDLPQKILWSRNQFFHINNMAKISEDFSVNGVMPSDYKERLEELFPIVCDTISASSTDAALSILGVDIAPIVEFREKVIHTRQLLRDVGAEVPVHLQHHPIEKFILVARCEPIRNLPRKHGKVEKACTDLENTREKVLSNVSFTAAFRRQVAEVEASLAERVNCGVDTEDGQILQKFFVQLMEDATKNAGIIEYWDRFMALRETSFDTPAFEPLTEAIIASVLHKLALHARSGTLDADLENSVYPTVCKFMSYVRRARGGKPIADFCRTFPAGRPLLSRFFQQSKENQIMRLELNSFAFTRGPNAMWMDDFSELAHTSETLYPPRNSAVISFFRMVRAASSTPQSAEADALSVRRPSAFVRSLSEVADLVLDKLRKKRNTMNKWSRRLVTSILRVVDAAILLAIQAVQRFAATSRRQIAMAREEIKVQRGLERRVSISSRQDGVRGRQEGSVAAPPAAPLPEDERRPSAVAMVQVGVTSVTSMLYKRIALELLKVHRYIPGWVASALGTSTKDLAFLLRTKATVPGSVKDIAMSTCVNIFDNIVLPTLTKPNVLAPETMIRNVLAQLTSAIHYTVMPNLGAVEEKFRRARSQDGMLPLSAFLHGIVLSAVTQLESLMQNNKWQTEMVRLVQEHIRTLNSAVIGLVKRFRLADALCGITDPLLDAVADVVERNARTLAHLLTDLMQADTFGLLINFVQAQLFKELRLAADSGEVHGLLQILSSTGFLNLLADGAKGLYYVYNKEQL

SEQ ID NO: 528 - protein, 151 aa, Neospora caninum
MSQGESVYTDRYTSQETFEPRSPEEIATLCRAWEYYVHPRAKEFWQTSEARMEILKKIAAGVHRDYDPVLGDDRQCVIWYGDLSEDDHLPVIRMVKPGESQESQTYVNRTLVFLYADEESFNELQEKPKKAFTMACGNPMCVNLTHIALDE

SEQ ID NO: 529 - protein, 135 aa, Neospora caninum
MSAKGAGGRKKTSSGKKVSRSAKAGLQFPVSRIGRYLKKGRFAKRVGVGAPVYLAAVLEYLCAEILELAGNAARDHKKTRIIPRHIQLAVRNDEELSKFLGGVTIASGGVMPHVHAVLLPKHGKSKGKHGVSQEF

SEQ ID NO: 530 - protein, 217 aa, Neospora caninum
MARQATFIVALCVCGLAIAGLPRLASAGDLATEQHEGDIGYGVRAYAGVSNYDGDDDAAGNPVDSDVTDDAITDGEWPRVVSGQKPHTTQKGSLIKKLAVPVVGALTSYLVADRVLPELTSAEEEGTESIPGKKRVKTAVGIAALVAAAAFAGLGLARTFRHFVPKKSKTVASEDSALGNSEEQYVEGTVNGSSDPEQERAGGPLIPEGDEQEVDTE

SEQ ID NO: 531 - protein, 99 aa, Neospora caninum
MVGTNAPSAQASCVQHVGGARTSVPRRRVTSGGGASNSAAQRPRGMPASSQGILRFYTDDTPGLKIGPQTVLIMTLCFMACVVLLHIAGKVHQTYGGEN

SEQ ID NO: 532 - protein, 89 aa, Neospora caninum
MADRKAVIKNADMPEDLQQDAIDCANQALEKYNIEKDIAAFIKKEFDRKHNPTWHCVVGRNFGSYVTHETHHFIYFYIGQVAVLLFKSG

SEQ ID NO: 533 - protein, 147 aa, Neospora caninum
MTDVVAPAPSSTSQAANSTEGDAAAGSARPDNSILVSMDKIPGFYARIGKRMLVGRDDKPACDEVIITGLGMATKTAIGAASLLQRDNSATITKVETSYFPSTRTALKMVPKITIVCTKTPEFAEQIKKDKEAALMEKSPTANAVAA

SEQ ID NO: 534 - protein, 163 aa, Neospora caninum
MSDWDPVVKEWLVDTGYCCAGGIANAEDGVVFAAAADDDDGWSKLYKEDHEEDTIGEDGNVNGKVTVNEASTIKAAVDDGSAPNGVWIGGQKYKVVRPEKGFEYNDCTFDITMCARSKGGAHLIKTPNGSIVIALYDEEKEQDKGNSRTSALAFAEYLHQSGY

SEQ ID NO: 535 - protein, 132 aa, Neospora caninum
MATVGTPVKLLYEGLGHTVTVEIKSGEVYRGVLENAEDNMNCLLQTVTVTHRDGRVVSLEQVYIRGSQVKFIVFPDMLRHAPFFRMMDKAGKYKRALGLVGMRRAMNMRARGARVARARGGGRGGGRGGGGM

SEQ ID NO: 536 - protein, 236 aa, Neospora caninum
MAQFHREIGKLFASYSNKITGNSPVQYVPSPPTKGKVRRALSSALMPVWFKFFRGPLDRWNLAVMAKYLRDHGLMYDDLYSDKEPVFARALELLPPDIQAARFRRLMRGVYLNHLRMYLPVHEQNYDPFIPYMAPYVEEAKFQLQEEEELLGYHMWEGVWYSGGVTGFGDKEPGEHFLLALPNLYGAGGSPMQTGGKHFSTRAAAAARARLATLAEKRLEEAMKQRQEVTALGSEN

SEQ ID NO: 537 - protein, 134 aa, Neospora caninum
MVRTPRYPASPVQEIFLPEPVPFVQFDQSAPSPSNPPAALPAPSLSQCEEQKDRYRDISSMYHRGLAGAEQVREAYNSMAKCFRRISVFEVIERDPALRQAQNFTMDLKQAEEDQRYKQLQYGRVPSILTKYHL

SEQ ID NO: 538 - protein, 210 aa, Neospora caninum
MAGDACTAAAPAVPPAASLQQSGNARQNASVCGAKTPGYLDLVGHSLKATSMDHGMQYSSIYWETSHRTYLPFWASLTQKFSWKIMDDQIRSALRLPKPVTSEPFVFSSGSPYLRKYFGDADLSVPVPLQAPAHFAFVPTGTRAPWEDVAQETGPQAAAARGAAATAFRAVLESAWKCDMDEQLKQKMQAHTTAFHQSGSTGGCPIPTEF

SEQ ID NO: 539 - protein, 290 aa, Neospora caninum
MYEAIPAVPLFPPADGLAGVGKVRAPVLQPTPWLQLRRETTSVPIKQIDKFPQVAKAADAVIMWCIHEALKRVQTGNENSAGLTGAVQILRQSVDLREHIRKKQEEALASFNALIETASKEFSGVDIRLFRFWGMAANLKGQPNEPDDMYVESMEQTRWLLSNALLRATGQLSGETVDSKLVDCEHLTYTAYSSKLRKIFTLKESKTRFCSISVTGWILFGARQLFDIAKSASESGDGEATATLVSIQEAIKKFEGVKEDLEQLWPVFEEYRSTVLSWLPKPETTAEAEK

SEQ ID NO: 540 - protein, 202 aa, Neospora caninum
MFARAFSRFASLAAPQGVRNALGLPSRHFSTGTGNANPFKNQLLLTLSSPSEAIYVRTPVRSVTVPGSEGAMTMTNGHSQTVARLKAGEIIVRKGESGDDVERFFLSDGFVLFKRQVRRGFNRISYSVFNGANLGSPEDDSGCCTAEVLGVEIVPVNMLDKESAATALQELLQQGAGATDEWTKARTLLGQELLSSVIRAAP

SEQ ID NO: 541 - protein, 189 aa, Neospora caninum
MTADVCAFDTSVVKRALHGNYVPVGLEHFAGVSVALFFAKSKHSKCAQIFPTLRQFYDTTNASGEKQAVEIIFVSLDKDEQEFERFRSLMPWCSVEFNSPLRKNLLKRYRVADDEIVVGEIRIPAAGLPLLVVIGPNGEEAGRLSFQPRDESGFQQWDYRFNKWPGSAHRMSVSHVAAEASHKQLPQNA

SEQ ID NO: 542 - protein, 343 aa, Neospora caninum
MGGGGGGALNKLFPGYKDKIWLKVPVQTISRGTLVEGADFYLPTAQEQQRLARHFEPYSEQTRRKKKVPLPEISVYLAVALGASFVHDYFYQRRPVAWCLEKEPPHPPSYPFWFKSLFHSHDIPSVRRGYEVYRKVCATCHSMEQLHFRHLVGEVLPEKRVKQIAAEYDVTDGPNDQGEMYTRPGILGDAFPSPYPNEEAARYANGGAYPPDLSLITAARHFGPDYLMALLGGYRDPPEGVELRPGLYWNVWFPGNAIAMPPPLMDEMIDYEDGTPCNISQMSKDVVNFLTWATEPTADERKLYGLKCVSAIAIGTVLMTLWWRFYWAMYATRRIDFGKLKYL

SEQ ID NO: 543 - protein, 305 aa, Neospora caninum
MFLTYVVRPGEAPEGRGPQLEPFWYFMVNYNLRLGFLIQLAAYMGILFTISSSGSDCLSVIRFFRASPEAVGQTPVWVVQLCCGVFILGSLMTMAFQSLVDDDSSIKQSRGYRSGTKFLQFGSSFAVICWILSLLVFYAANYYFDDPWMQKQLGAGSTWITFFTARLCDAFALVFMGAGIFFLEVYHSEGAGEAWGWLCALCFKLTALIEVIGLTAFGTENFRVVDAMYTIMLGVSLSLGLVWALLFEPVSHRFDVKLTQSAMRNEYYKSRNAMAYYGPAVVNADGEVDIAAAAEQVQACLSCTA

SEQ ID NO: 544 - protein, 413 aa, Neospora caninum
MDDMASLSTPAAELQRAMSARKRARGQDGNFVLSPFSIMFVFAMAMRGANGPTLREMQNFLKLTSLPALPKLDQEGYSPEAAPQLDMGSRVYVHDEFEGNKHFLEYVDLLKKESEGQTGAKTIDFSDAAKAVEEINAFVADQTHNHIKELLKVQDVNPLTRLVLVSAMYFKSAWATQFPKHRTDKGTFHALKEGALVEQQVDMMHTTLKDSPLAVKIDDYVTAVALPYTDPSTAMYIIQPRDAQHLSTLFDEKKSAELGLPYIESIIRDMRSDATADENWGKQLRLSMPKFKLNAQANREDLIPLFKEVLGIDLMFDVQKADFSKITGGRDLVVSSFVHAADIEVDENGTVATAATAMGMMLRMAVGPTRTVDVVINRPFVFQVRYTPPSGSEDRSDDYVLFSGQITDVAAAQ

SEQ ID NO: 545 - protein, 382 aa, Neospora caninum
MAFLSSPLFAAKASLAARVHTLGCPATVASPLCARSFTSPLSAVLLPVSPRRHFSVYSHNIRPDKHELPASEVPLFYNRFDQADHPSLWQLEEQQQQKHLDKEVTDVSELVEPVSSPHQTEGWFKRVRYWHYKETAEPTFPRTPDLSKGELAAGATVTRTSVWHDPNEPAIVSISRFTPDNFRAVGFAENIPNPDSTNSDAHPDFREYRLGPGSVDRRPFVYFMSASYFFITASMMRSFLCKWVHYWWVSRDMLAAGTTEVDLRPIQEGMTAVFKWRGKPVFVRHRTAEDIAKAQADDALIGTMKDPQLDSERCPRPQWLINIGVCTHLGCIPTDGGNYGGWFCPCHGSHYDTSGRIRLGPAPANLELPPTVFLDDHTVKLG

SEQ ID NO: 546 - protein, 265 aa, Neospora caninum
MDTKSENSVATGVGPAPAGRMPSYYDPEIGGAARTAQEEIDERIFTKEIRQGFIRKVYTIIALQLITTAAVTALFLFVDPVRAWFLTHGQPVIIAAGVVLLVTSIPLVCCEGASRRFPFNYLLLCVFTLAESVLVAAVTAHYSEKTVLIAVAGTAVITVGLSLFACQVKYDFTSWVGVLFIFALNLMIFGLFCIFLPKWAQVLYSSLALLLFSIYLVVDTQLIVGRGKLRLSEDDYIVAALMIYVDIITIFLHLLRLVASATDNN

SEQ ID NO: 547 - protein, 488 aa, Neospora caninum
MRRSTGETRLSRNFFLALFSLKISVVAVLFVSSLVFVAGLTWEDDNELAGDVASDSDNSSESELGDVKLAGAGQQQLLNQLKNELGSDYADADVSMLQTDHGIHGEEAGVLRKAVPGMEDADEEGSENASEEEDDSDATNEDQEDEMSFIENGSADDKDNSEEADSEQEGDEDEASFMEQEEDDDVNDSEDAGSFHEDDDSEEERYVDPYASDALSYLQQGDGSSAQGRLAEEEDAPASFVQIDGGERQIRAHVHLGNHVARDRLAHAFNQDHVRLLDQTPVEEELLSEAAPGGGDNAVVSPNEDGPAEVESNMSEGEEGSASAPVEQASAQEAESSAAEEARSLDAEPRMMAAEPVKQPQGALPAEGMEPVGSQAAEARDVVEPVAKALEPEALEAPPAVVPPAETEEGTAAQLVEEMSKQDQAMQEAQPQEVLKRHTWQDMERTQDLRKNDVAVTVSGSQAVTAASAVALAGLLVGGQLLFSVGMC

SEQ ID NO: 548 - protein, 322 aa, Neospora caninum
MASGPAGCSLPLRRRLVLFSLVALLHAGIRPSATLSLRVAARTDTRGHALRPPAAAPAGAAPQTNSLPSSQPASASPSSSSAPEPPVFPALGFGQLAPPVLMLVPQMPTSGSPPVVDKPETHEAPSLLPSPISTQSASLSFAEEASEHKSSEDSASSEDSASSEDSASSLPSDLQCTVAFEGPIRQPPTLSLSSSSPAGPFLAILRDRSPEANGWIHGFQKNLHAGYKGPFGGEEGEYAMCHPPSGQHVYDILVFDKDYTLGPKLKAMINTPWQTRARALGSEEELIKDLTRNASSEGTPTIVTRCSVTVSHEQVTAEEGRE

SEQ ID NO: 549 - protein, 430 aa, Neospora caninum
MASDGDVDTSIEQWKIKRLIKNLESARGNGTSMISLIIKPKDEITRINKMLADEFGTASNIKSRVNRLSVLSAITSTQQRLKLYNKTPPNGLVVYCGTIITEDGKEKKVSIDFEPFKAVNTSLYLCDNKFHVEALAELLESDAKFGFIVLDGNGALFATLQGSTKEVLHRFTVDLPKKHGRGGQSAMRFARLRLEKRHNYVRKVAETAVQMFITQDKVNVSGLILAGSADFKNDLATSGMFDQRLQAKVIKIVDVSYGGDNGFNQAIELSAEALTNVKFIQEKKLIGRFFDEVAQDTGKYVFGVQETLQALEMGAVELLIVYEGLPLERVTLKNPVTNAEKIVHITPDQARDDKLFKEDGVELEVSDKISFSEWLVNNYKSFGTTLDFVTNRSQEGAQFERGFGGLGGILRYKVDFQDYDETVDLEDEFI

SEQ ID NO: 550 - protein, 400 aa, Neospora caninum
MATSAAGLVVLPAPDRGLRRMFDLTGYAGKPSFSARKGTCGEPVDDSWQDIIGEHRRPKVSSLTSGSGMAGVEAGRMNEIHQHTRKRVDPGKGCSDKVRDLLSCTPVQRRYSEGFLPTEKGGCAAGQVPSYPAVRPSKRSYLRVCAGDLPDQRRHFQTRWQAIDGKMEFCTCRKGGSASVEFDYELLDREATYHTWKRMQGAYNRRGRSNLQWDRFLTVESDAQRSDRLPDVKNRSPPFANPDGPFETRDVRRHPMEVGSLDRTLCPRKGEQTADNQAKGKAPGAAASYLQKSHFQTSSLTPVPDTKPRSHYRKSVYGNVNAEDSMYYILREGVGGCTNRPSTLEKQERPAQVAQLGASAPEQPQQIHQHQGIQRQTPHSEYGVSPSEFQAASEPSSDRL

SEQ ID NO: 551 - protein, 337 aa, Neospora caninum
MASNAKRTRGYCLSLAGAALAYACLLAICAALEITEGIRSLHVLKSPLSHASALVQGRIISIFLVASFDILVAILSVAAVTFRLPQLTSFLTWAALVNGVLSFISVIVWYFGVRASLWIVLGVAIPMTRIFASLANIQSAGGDGFEGRSYKMLGQVREDVLSGPSEMRKLGTWGIGMSVGTGALVFSLFCLFVAMLECAGYWNSRLYAATTHGPNTCLFIHGILLAAAGMAGLVGAIGVWKSFTSLATALTVLAVPLSLCVLIWWNIVSSTDPALSPYSFLDANALVKDQWWFLAAAPVGLWCYMAMIRLQEKRMSGFEGPDEIPEGEEQKLLADNI

SEQ ID NO: 552 - protein, 97 aa, Neospora caninum
MGKAGKGTGSFGKRHGKTHFLCIRCGRRAYHTQKKTCGACGYPNAKKRTYNWSEKAKRRHTTGTGRCRYLKDLPRRAKNNFREGTKATPVKKRKTQK

SEQ ID NO: 553 - protein, 344 aa, Neospora caninum
MAASSSEKPSGKTGTQKMSTGPQKREMKKRSANGSNAQAEPAPSPPVASPSWAQSGWQTLVASPAAQLRHSAHRYLRADVVPFEACVSLVFFAYCVLALLSLKVVRGLLSGGRGQRGRGGGRRVVLLGPSGSGKTSLFLLLRNGRVTETVPSMQENSDTVSVFPTSAADEDAAGHVSPREGCEGSEADRLAAKIDLVDFPGHARLQGLAKPFIDEAAALLFFVDAADKAALKVAAEQLYELFADPSLHRRQTPLLLVVNKTDLPDARTQESVVEDIEREIERSRASRAAMLEGEDDGTNFIGVEGDAFKILSHVPSPVAICSCSVKNDETAEVRDFLLGLFPPN

SEQ ID NO: 554 - protein, 789 aa, Neospora caninum
MGSSASDFSPPPPGAPSRCPRSVARHSTQPMQSWRGLSLLRLLLAFALFSVLLYDHWRILGNALALRTASRAETALQATTPSAMTPLTNGQVVEMTASTFSIVRTWCTMYQAQWQIFNQMCLNKELSGAFKQAAANGESALFDFRNYSGLQVQGEVGVVPGTNAPVRIVRDPNSPTHAVKYIYGAICTGELNYACKKVLETNVSTEMTDTIAVPTSEEVEKILEHFDKETPLEATARAQVAEQMLASASSDEKGSFPDVQADATETAPSTQPEDQASPTAASPTATGTDTQSSEDEKETENAAKEGDEEKPADGSDSEGADAIEQKAVDAAEGDGSVFDTEGQDSPGAAAQPESSPSADDKEPSGDADETSGDLPTDSQDTPATDSFDTVSSSDSTGPASGNADTSTTDAPAADASAATEGSEKSAGGDGDTPTTDAPAADASAATEGSEKSAGGDADTPTTDAPAADASAATEGSEKSAGGDADTPTTDAPAADASAATEGSEKSAGGDGDTPTTDAVAADASAATEGSEKSAGGDGDTPTTDAPAADASAATEGSEKSAGGDGDTPTTDAVAADASAATEGSEKSAGGDGDTPTTDAPAADASAATEGSEKSAGGDGDTPTTDAPAADASAATEGSEKSAGGDADTPTTDAPAADASAATAGSEKSAGGDADTPTTDAPAADASAATEGSEKSAGGDADTPTTDAPAADASAATDGSEKAADDDVDTPTTDAPATDESAATDATDSSDSADAAETPAGDDQETSSTADSQEAANESGEGGEDGNASS

SEQ ID NO: 555 - protein, 502 aa, Neospora caninum
MAETAVPEQLLEEQTFPEKPDEASPSENFADAIEEHAASDGIPAVAHLPAEGGEEARACEDEGKNGKRDDEADKADEANAGEAEKEGQDAEHAEENEETKDDGTNGADKPEDPDAALKFFVGGVNPQATELQIRSYFERFGKVKMVELKMDKMTGRNRGFCFVTMGSEDAKEAIFNAQHAIGGKKVEVRALHDDGNVSLKRKIFVGGVNPSLSESDVEKYFAKFGTVDKVSIIRDATTGKSRGFGFVVFASEDSVKEVLKSRRHNLNEKDNCEVRAAESRATLPPPRPRYPMARGPSLPPSGPRYPPPHAMAHPPPHVPPPGGYYAAPPRSSPTYYYGPPPPVAPAMSPGVAYYSSVAPATGGYAASPSPYYMPPAAGVAAAPAATASVMHPQAAGAAGGASTLVSHSLGSAAGYYAGSSVPYDGGASAAGGAAGTSARGYWDEDSSAGTAASGAGGAYYARTASPGAAASTAAGYSSGYSPVRQSPYYGAVGRSNVRRSPY

SEQ ID NO: 556 - protein, 491 aa, Neospora caninum
MGRSRWLLPSMFLLGLLCASTKFFFPVCGLHLRAPPSPLWETRLPRDQPAALPPFPQRDSFLASGANPPQAFGANGNSESATIWDGAQQMHDEDPARGDFPLPLTALPVQPGNSAAGDALNDSQEQELEGGSAPAGSEKTEKMWQSSSLVDVSPRVGEGEEQAPTVEEKAEAEKLGDQAEPSTVDASTPDVLATYPSVPNESSGSDTSGGSDVADISEASNNGPDTIVNGAKEPIPGETGAETLRDDLQGSESMPETAPVVDTVDDTPQTEDRVDPGSASSGVDGSGDNTTTEDSGKGTGEPKEMEEMTSPVARGGEAAAPEGEAVTETEESVPGHPEGEENTGNMSTQDLTSHSVEEAGRISVVPFAFGNSPRLRRWTTQFLVRGKEMFPLMQKADIAKQAEKRAESLRSSMEILHNTTAFFNAFRAQQRGKNTHEKTKRLSAASVPASQQEEPNVIPEEGFDASSLPETGAQDAAEAVDTAVSAEGSNN

SEQ ID NO: 557 - protein, 583 aa, Neospora caninum
MSRTGVFEPNRGAEGHYTSFPKDPSTMYYGDTSSGVAQRSPSTPGLYSQSRAFPSGRGFPKQTDETALPDYPLKEHAFHHDVSPVDEKSQWAGRTSYDKPASMEKDSCHHGRYFGADLDPKSQEGGCWKMQPSLSSHSAEYESGKADCYDRRSLRPDEHMSLSWNQAEGGNHGSLPFLGNPPFEGNSYVRSPTMQINDSQLQTMKGRDPFAQDAVRQRALQGHRTANLLSVCYHGTCTYMRERTREYIIQPAGKEIDWSEKKLFRKALPSSIFASDQVAERLRQTLPPPGTEAERRPKSDYGNRRNWSQIENAPIYTAKVEERSFDSSLLYHGCRHLKRQSALGYVPDEVASLLRCSVEPEKGERTVVPSRSSLTSQHDSAQLRRILSHEPELELDAEDYGNQRPCFRKSPFLTSKNPYRWGVSVFGYDRSPPRRNRMYALRDHLDSKLVPSHSTDDATHIRLRNAPLLPGSLHMSKLVPVKDFPSTSAYRTRRDRGSLDASLVPLDGGGQERVRRRPISRPDRSLQENFVPVHDVVSRHKRFLRKDRDSLQANMVPGIKEPTRRLKRASSLCRPSSVARGTF

SEQ ID NO: 558 - protein, 321 aa, Neospora caninum
MEVPPTIHVPLPPTSYPAFDAAIFTDIGGRKHQEDRFTLCPQLVPGREDCAFFGVFDGTVGDFASENVKDLVVPQLISSPAWQQVTELLQSGLPAAEVDEKLPQLLDQAVDYMYKNADNELVKMCEQLNKDYASSTSVTAVLAKGFVAVGHLGDSRIAMGVETPNGLNCEFLTVDHKPDMPQEKLRIMRNGGSVEYLHNHNNKPFIRGGDFSFRKSRGEQPMQLQYSRAFGGKDLKMYGLSNQPDVRVVRITPQHRVMILATDGLWDVMSAAQAVEIAMQARQEGRNPAQALVEMTLAEQQGRNQSADNITAMTVFFKKTE

SEQ ID NO: 559 - protein, 473 aa, Neospora caninum
MPPSAQPSEAAAASEAPHDSGRRGRDASDATNCVAALLKEGEDLVGVDTRKAIALIEEANRVAYQIAVNDTQVEKRQLPPPSVEEAMRLQEQGIALLASLYANQGDCESLQQLMRSSLPFFSLLAKARTAKLLGMLQQAQPILQQLLQEVKKLDDKLLLVEIHLIESKLQFKVKNYPKARAALTASRTNANAIHCPPLLQGDIDLQAGILAAQDRDYKTAFSYFFEAFDAFSAQDAAHHSQKAPTAAGAAVAAATKCSSTPAGPSKALQALKYMLLSKILQGKDDEVSSLLTGKQCLRYYSMDTSSTCKPAEASTAGGPVGDAATAPASGARRDLEAMRQLALCHKQRSLKKFEEVLDMYARELKGDEVLMHHIDELYENLLEKNLLKLLRPFSRVELAHVAQLIGLPLAKVEEKLSEMILDGKLHGTLDQGVGVLLLFEEQVLPEMHVDALATIKNMAQVVDTLYEKSLQAL

SEQ ID NO: 560 - protein, 770 aa, Neospora caninum
MFHLRLLGVPLISFVWALLAAAPRSTPQAVTATRVSRDHGHHVSVHYVGRNREGRSSGPSSWGLSDRSSSPLLEPIPKSVELASFIETSESPSSGGIWAGLKRYVELGTSGERIPTKDESKIKEETNKDTSGGDTASPDSDTPVEAQPSEATESKAVSTHEHHPGKETGADPKSETYHRMAQKELRDARTSLVKQTNGTPEEYGETGSFPSLCGSWQTVPSSPHFPSNATFTRYSEQDASLLEDQSDAADALPYPTCQWLPRRGIHISERRTYGFEPNVVSIERLEFHSEEGCLPTHLAKIWRYSGYWHPESAAKDSRTKAEEMSVKGNFVYSQAVPPEFIILPQEIPVSHEVLANRLKHRLRRRLSVLQQKHGKAPNTPRDDSLKSEAEEAIASNWTDTVDRRFVTRWRDYLVQQNRWTEKVCQWHLLRESCLVPPPLAGPAASKKHTAGGEGKKQHESHCYIPSVRHSLTREDSIDYLSVPLFPFTKDAEHVRLRKVGGCNPHLQVSLRRDKDTKALAEEQKRHSAEDELASVAVTSKTIHPHDHASAPAVSGGAEEGTTPVPSETEEKGVRAHGLAENTPQSASETTAQNAPAGPTGEQDLVEPRTQEEPIKAVTQQAPPVEQAPPTEASAEETGDSQQPEQVSAAAPEQSQQPPQPLQEQDASSAVEQPPSFEGQTEPQQAQSSEAAPEEAAEKDAHHAPLAESPSSETADPQTAEAPAQEADSTTPAFDASSTGAATPTVTEVSDQEGDGGNEESSSVAEESSSE

SEQ ID NO: 561 - protein, 444 aa, Neospora caninum
MTQPLVESEGAVPASSTPTTASSPSAATSSSSGIRVQAGSGGLSLQQQQRLAAHSHIKSLGLHADGTAMKTGGGMVGQEKAREAAGLVVDLIKTKKLAGQALLFAGPVGSGKTALAMAIAASLGPEVPFVPLSSSSVYSSEVKKTEVLLESCRKAIALRIREVKEVYEGEVVEVAAEETENPHGGFGTVKRVGRSDSHSTEFDLEVEEYVPVPKGEVHKRKEVVQVVTLHDLDVANAKPQGGTDILSVMGQFLKPRKTEITEKLRSEINKTVNKYIDQGIAELLPGVLFMDEVHMLDIECFTFLNRILESPLSPIIIFATNRGVCTVRGTDSIEPHGMPVDLLDRLLIVKTVPYSISEVIQVLKIRSQAENVRLSTEALELLGEVGSHTSLRYALQLLEPARILAEVEGHEVVERKHIEDVDALFLDCKSSAQRCAEMRDVLVS

SEQ ID NO: 562 - protein, 486 aa, Neospora caninum
MEIWVRSVLSCCIFMAAMLAAAAGTGGGALYIPGYVVALRDVHKAVPLSKVTIFGACLVSVLFNLGRKQPSGNLLLISYELAAILEPFTLMGGVLGVLLNIVMSDIQIICCLVVVLSFTTYKTTRRGIIQYQTESRLLAERAARLSPMDRQPLSAWDREGEEETSSLLAGDEPRSTVPVCTGNFLAVSSLAEMMETPQVLLDPLPDDSGDRRPQLAAKGEALLPASPDENAVLVRERKELLEAKRHPSWISLAYLIFDVAVNTLCLLGAGGPIAVVCGEPWQQALIFFLISFHVFATALYARWLLKSKRRREQLGIRDEDVEHGGLGWVSARTVVLYPFLSLLAGVAAGSLGIGGGLIKGPLLLEIGLNSLSAVTTANFMIFFTSSANALQYATLGRLNFEDSINFFLVAAAAGAVGLMCVTKALKRTKRQSYLTLLLAFTTLLSMVCMLFSFGYHHFRNVVTGKEKPLTIEDACQERHRLLFVHS

SEQ ID NO: 563 - protein, 1369 aa, Neospora caninum
MRPRSLFFSALCKCTRERPSSPSLFCLLSVTLLLSLADSSLWLSHPSLGDSSASFLLPVCEASQHPSSSSRASPSPSPSLSSAPFPVAFERATAWGAYRPAAYFSLRAATHARGFLTGLAWGGEGIVSSTALHSALAHASHPSGLAQTSPDSEGARLAPGAPQGEDPLEWERARRKREQVHHLIRDEDILDDRRCKGGSKGESETTVAVDACTEGTQFQWKEHDGLFYGSQDILHRRRVSPGARPVDTEDLKIRTTFAKHPVHADKIFSFRLSASVERGERGQAAERNQAATVASLFVYFTSEDEDFAVFLHPDTKRQKIQAARRLYLLGRGDSAAEDLLAVVETKLQRRERGEGEKGDRDAAFGIFFGSSLLSCAATQAWDAASHIEHLLRKSHEKPATSRGEGLDAFRHLPNEEEEDANFFALQVLGSVPAKAAKEHRDETDEEDDGDTWEEEAEEDALVIDVHVFTGGILGKGDARIDGANPRAQTSAPGRPQQANSRCDFDCLSSLSIEEIDKRIQAFLFSSSSPSSPSSLSPSASSPSSLSPSSSSPLGGHLSYLARLYSRLFHLHLEATFPGPSPLALRSAMISNLLGGRGFFAGKLPVSPAAHEAAPLESRDEEEQTASEGERPAKPEHDAPGRLLGDLALFSFVPARMKFPRPCLWDEGMHELVALEWFPLLAAQNLVSWMQMLKTSDQIYPGKSRLFLLSRSSFLSFGSSLFLSLRLCLCLASSRFRCSEMAMGMPPAFLVQHPEAGNPPTLVFALEKLVDIAAQAPRLRHPLFRLLTQNRLPSRDQIEGIAALAVAGGKRRGQSETKRGGQTPASLLSELVALTDGPDGNSSAEASLSTVLANCIQAIAPLLTQWINYYVHMHTTIIDEAPNTSSSPTSSSSAPTSSSSAPTSSSSSPTSSSSSPTSSSLPTPPPSSLSLLLDPRRYPKWHELPPSAPAASFSSGLDDFPRPLQVYDRAEEAEPPAAHLDLHVWFLGLLRGAERVCAFLENRTAGGPRDTQRTKESRACRETYGPALASLIVKLLGVDTPQSVFTSLLVSDSCSAPSSAGVCNWRVQPPTASSLYLHAAGILVDFATKQPLVKTRREDEPQRLVPVPVWPWREDGRCGREFPIATGRPALCNPLSASPCCSAAGFCGASQEYCACASCFRTPALTERRFWGYEAVGPAPSSYVGVPSLLPLALGLLPWRGHLPFLVASGPEGDARAARPAASGDTGDAREAGDVLLRRVMDVAENEELGFSSAFGLRSLRKGDALYHQASDYWRGDVWIHISAFVLSGIRRFYLNGLTAREMQPGDERHTAFLKNFYATVRRRVLLTVEREWERKQQFYERYSDIDGTGKGPFPFAGWTTMYLLLLTEK

SEQ ID NO: 564 - protein, 615 aa, Neospora caninum
MPLSRFSVPAASRTADQMARCHQAWLNLAGGMTVCFLIVTISCLYLESSALPLRSRAKNDVFGGLEASAHRTQPRAGGATHLPQRGTTSHFHSRGKPSWRNHGYASWSNNYTLLTEETAIGSQHLARPTGLSLIENPGDIHDEGDAVAGAREERDVDAHLHPEDGAPFDRLALQGEGPLNRHPQAQTGPARSGLRTRIKQNVGRLWRVGKRALQKLGQRAKQRIGEFVARHVRPRLARLRFWDAGRPPVVPPLKGNEPGQADVALVAARMQAGVRQKAFREKNLTEAEKIIGSYLISSAEKTWFSTVPGGRPIVLIKRGFIGGGGFGLVYHVEHPGTRQAYALKAFIRDDRSGMPLEGLSASIEEEFDVTNGFPPEWTPLRIYSELRFMVPILKLRVQGKPDFQDVRRHFRVASTCALFPKAQGDLGELVRLLKDVDSDTAFRVRMSSTIQMVKLLARFHSFGLVHGDVKLQNFLVEQSGLLLLSDFTKIIRGNSNYFPPVVTAAYMSPEMATCLVNRLRDDIAYTSRTDSWMLGISVYKLWCGAYPFGIKASSRLTEVAGILLRVHTSLPDFSRCHHIPRQFRDMVRGFLRKSSVLRLDPQQALEDIPLLQWTG

SEQ ID NO: 565 - protein, 487 aa, Neospora caninum
MAHNTASAILKDDADGLGVNEGKMTEDFSQATTQLIEKISQLQKTTSVGPTNPIFDELFALEKKCRQANDGASGSRLCCFYLQNLEDLRKAGEEKKGDGVPMISVTFLCDQLVVLCKKRGQLKRTISDIVKLAVSWLPEMKKEDKIEMIETLKKITDGKIFVEVERARLVLMLAEMKEAEGKIDEAATILQEVQVETFGAMERREKTEYILKQMALVLRRGDFIRCQIISKKISTKLLDSDENLQDLKIRYYSLMIVYYLHEGLTLDCCKAYHSIFNTPSVQQDKDQWLLSLQCYVLFLLLAPFDDEVRQLAHAVQTAEAKKLKEMPVYAQLLKDMTTVELLSWPLPYEATLKAHEVFQDSPHEGGEGRWKLLRRRVIQHNIRVIATYYSCIEMGRVASLLDITKDEAESEISELVCSNFVEAKIDRPAGTVVFGKRKGTFDRLNAWATDVTNLLDRVDLCSHLIQKERMVHAARAKNAALLARNAS

SEQ ID NO: 566 - protein, 1312 aa, Neospora caninum
MVAARPDQSVPLRQVGGKQAAGASGRGLVRCHLQKAALKRLLSAFLLCETLVFSTAVLGAQFEDEAGINDWLSEQVAGVTHLIASEDTGPSENTFFVGTSHGVVAAFSEAEGSLRWRRVHRESDRVARLERHAPYLVALLQQPARAPPSTTGLTVAPEAVRSGLYVQLDTSGSLVWSVEEGVRDFAVGRGPDGAPAVAILRPGGRGVEVRNLKDGHVVWAAGDGAELGDQTRVASALEGVASVLAVAHLPQKEGALVLLYKKGPSQSEVRMRVLAFKDGKQLRDAPSHIAAPGTLSLVQGSTDCAGFLKTTASVDSPPTLSVVASNGQDFFVSKPLSLAAPGKLPRSAVSPSVHVAALPVAGCFFAVTGEDSRQTVILRGEGSGEQFQLRQHYTLAAGHWAFGKLLVDGNRTGSDIWTQLGGRDMASAPSDLVLATTVENDTLRAFVMDARTGVQVRYLSLPFEQQKSDAQKLAMAVAKQRSTAGLVEPSLISAELIYGRLLAGEDPSARRAVLVTSDASLSLVTGAHWVWSREEGLADIRGTVMFAMPYTASRPTERREWASLPFISALLPSGLERLALEAALASPSDSAAQRSWAEYLKLQAARLTASAVLGVAQMLEATVAFCREAVQGVRRAFKMSSGARAGAREGAEDVPLRACFRPGKRAALAPFGFASLSAHTKLRLLGFVAFEGASEETADLALNAAAAEEVLMPRGRKAPAVHVDPRLFGWTELIIAATCSDQVYALHAATGLVIWQQSLRFWKTREAHRAAYRACRASSTLDSSPFVGVSATNGRKTSVLRVRPDGPSQGGSLASRFAEGPLQTGGIVGMHLVGEHKKELLVVVVDSAEQSSRLVWLDASLGTVLHVAAVPFVPAHVVPLQAVDPYHQVASAAERDTQTFFESTNGALVVDASGRAPVLIPRKAETETELETKMHCKLARHLSHHLSLYELDVASQQLFGFLVRTEELQTGGQPGVAQCSLRTQRTWNVPFGGSGQALIAAARPLHSDYPHVPVSVTSNISIVYKYINPNLMAVVTKTERGDAGLAGAGASLMLHVVNLTDGSVVYSEYLPSAASMPLHLMMYDNVVMTHYWNLQHARYELHFVELQDAQKDEGPLSIIFSAARHIVPRLTGFELPPPTGISQTYILPTGVRAFGVTATLQGITTRAILLATSSSHQVYSMSTRLANARRPRLVDEHGRPPKEASPARQQEEGVLPYHPLLPLLPHDCISYYNQVFHVRGIGAHHTARESTSSTFAFGLDLFFAPVQPAKGYDVLNSQFNYGLLAAAMVTLLVLVVVTRWRAKEADLAAKWK

SEQ ID NO: 567 - protein, 111 aa, Neospora caninum
MAMKYVAAYLMVVLSGNDAPTKQQVEKTLSSVGIDVEEDIMDAFFNAVEGKTPHELIAAGMEKLQKVPSGGVAAAAPAAGAADAGAGAAAKEEEKKEEEEEEDDMGFSLFD

SEQ ID NO: 568 - protein, 177 aa, Neospora caninum
MFRLQLFPVFLLFIISAATSLCPDTFVDGAESAMEDNAKTVTFPEPAQDNIYTTNVKLSSTPARVKVLIESSAGSGGYAFMAHDVLEGIQKHPKLEFTPLADDEMKERLESSVSKHGVTVSKPSIEHVKQMPGASQTYVTPVEVTEAGDYTAIIAQLRPWAPLDGARFYVVHIHAEN

SEQ ID NO: 569 - protein, 160 aa, Neospora caninum
MAFASVCSKLPALARGSFGKPAVASVQAAANAACRVFNRPFSGYDGQPVTSEQLIKKSDDWVIEETNFCLGRTAPLRFKETDDLAHRVLHVMDSQLAKMHTRLRDGTCIPVMGLYILDVVDKPTPLHQFVEPPLLKWTWDHTYSEAYEDKPSTETSASKK

SEQ ID NO: 570 - protein, 192 aa, Neospora caninum
MATGCSLLIRNLCFETSPDRVRQIFEKFGRVRDVYLPLDHFTKRPRGFGFVEFYEEAAAQEAMREMDRTMIDGNEVYVIIAQDRRKSPETMRRHLEQTRRGGGPERDVRRRDDFRGGRGYARGDIREVDIRYAEANGMGPAVPGIGAMATTGHDTIEVLMTVTPGHTGGAPVLDDPRFVALFLAVCDVVFSV

SEQ ID NO: 571 - protein, 195 aa, Neospora caninum
MLSRKPGIGALAEGSASSLSYRGSASATGAASAASGAAGRRRGARQELREEQKMEVKEAFDLFDTDKTGRIDYHELKVAMRALGFEVKKAEVLELMREYDKQNTGQIDYSDFLEIMTQKILERDPAEEMAKAFKLFDDDDTGKISLKNLRRVARELGENLSDDELQAMIDEFDRDCDGEISQEEFFAIMKQTSLY

SEQ ID NO: 572 - protein, 124 aa, Neospora caninum
MPSIRDEVSFEKRTAEAHRIRAKYPNRIPVICEKAPRSDLPVIDKKKFLVPMNMLVGEFKYIIHKHINQCAQNSGLPLTHEKTIYLFVENTAPKAGALMQEVYEQHVSDDGFLYVEYSSENTLG

SEQ ID NO: 573 - protein, 201 aa, Neospora caninum
MDYFASRPSKGRSLPFWRMAVLFSLAGYCGLLVVESRRVRETGVARCFFRTGDAARDANLTPFYVPIDDRQMYEEGIRDYVAQMGASNDQFSVVCTETREKDVKCELCLYNEVSEDRKHVRQGQVLDTMLLECIEGKFSQGSIMPNSQYHPICYPPPQRPVRDAAEAEGRSVNPHQQLGDTGTKNAGEESCGTGSKETGGS

SEQ ID NO: 574 - protein, 180 aa, Neospora caninum
MQRTSVCHTLLPLGLTAFLILAGTSGADALTASLHTGRLESETPDAGTPSLADDAGRESESVKTQQEPQIAGVPSAIDTDRIDEQAKEAEARKRPKNSNMVRLMVTDKAGSKRFSKTVETSALHSKIVDELGGTVSVLTETGVTLIDLPMTVSDIDMGKLISEIIAAGGIVEGDSEVSIA

SEQ ID NO: 575 - protein, 258 aa, Neospora caninum
MFSTRSEYDRGVNTFSPEGRLFQVEYALGAIKLGSTAVGIQTKDGVILASERRITSCLLDHQSIQKIVEIDDHIACAMSGLIADARTLIDHARVECANHFFTYNEKMSIHSCIDSVADLALDFSDVSDGRRKKMMSRPFGVALLVAGVDDQGPSLWCADPSGTVTKYQAVALGSAQEGAETMLQEQYSQSMSFEDAEALVLVVLRQVMEEKLNCNNVEVACVKTSDRKYHQYSSEELQVLIDRLPAPTIPTATDLSSA

SEQ ID NO: 576 - protein, 146 aa, Neospora caninum
MTVILCSILFYSLGLVAPTLAALHACIKQKTSPNENAMLLWTQYFLLFSALVTVVFPYVVTPVFFLLPSWLLALVKVVLVIVLAVPKLGLTSRFYGWFLCHYVEYLDLVANALQHHVVVPLKTYVSDAIARMHASTEASMTSRKEL

SEQ ID NO: 577 - protein, 123 aa, Neospora caninum
MVKVRAYELRGKSQKELVKQLEDLKKELAQLRVAKVTGSAASKLSKVTEVRKGIARVLTVYTQKQREEARAAFKGKKFIPHDLRTKKTRAIRRRMTASQTRKMTVRKMKRTQNVPKRKFALIA

SEQ ID NO: 578 - protein, 324 aa, Neospora caninum
MWYSTRQEGFDDPRPSLRGPCVDLPGFLCCGASGNSYFLRGGSLLQVLSLSGLFVSYWTFGGSGLFGYELEGLSEEARASHSFQIAMAVWSGLYMIGAAYLVCFQAILADDACWARGYRAGSKILRLATFLDLLSSIMQFIFYLYIAKFYSAKWYAHFQEGGSERIFFSYIRCMHSVALLLYACAYYLLEVYHDEGAGDLHAYINASLFALAGTVEFFVLFAGMSGLATILIWLALVAVATWAFFFEPEVNEVSPSLHETELTNDVEQQVEKFARMSPYYPAEETGAAAPLTAAGSMVMGGVKSQSSMLAQEDVEIGVGQNYRQ

SEQ ID NO: 579 - protein, 85 aa, Neospora caninum
MKGASKMARPKAKPAKKAATKKAAPAKSSCKRSAAAKPAASAPSTASKKVKKMVTKKTVAKKAAPKKVSVKKTATKKATKGKGKK

SEQ ID NO: 580 - protein, 334 aa, Neospora caninum
MSSRASLGRPGVPGPPGRPRSILLLASLCSCLFQELIVSPVSAFRRSEGNLVRGTAVEKSTQNTALRWQPSGIDGRNHFHFEPVSFLGLLGDNREDEDGSASKTEDSATQAGSSTVAAEEQKAAEAESQQSESQGTAEKGHDSQDAPHAEPAKSEEQPTKEAHGANGKGVAASGQDDTVTGEGKKPEELTEQDFKQMSTSQGLSILLGQGKGMMQEAEHTLDGVNAVVSITDLMGKVRDDIRKDVEALNRTVTEEYQNIEQLRQLQDAQTAVLRSQLNYLIPLNRPEAPAQPEVAATAEQSGSSSSISFYGVFGAVCVAVVTIFLSEAHISSGN

SEQ ID NO: 581 - protein, 253 aa, Neospora caninum
MVLAAKQNLYSVLGVKRNASADEIKKAYRKLSMKYHPDKNKEPNAEAKFKEISFAYEVLNNAEKRQVYDEYGEEGLERLQSGMQQASHPFGDIFSDFFGGGFGGRTRETPKAPPSTVRLNVSLEQLYKGETLDISFARPVMCMHADDCFTKKPDCKGPGLRVITQQMGPGFIVQNQIQDDTCVDQGKAWRPRCKECPNGITEPETAQLSATIEPGMREGDEIVFDGVGEHKMGHEPGDLVLVIHELPHKRRFS

SEQ ID NO: 582 - protein, 265 aa, Neospora caninum
MYADGPIAGHPTEALVGGQNGYPAIPTSAAHIAEQMESGGARVEETLVRLNCKYQTLFFCAGMAAVTAGFIGALTSLLTLQLACLVNSTFLLVFGFVMMLLDVPGAPRWAGRYRSSIRKYFRFLTRLTGKALWLLFLGSMTAVTLWPSNRGAHALLFFTICLSFFVSSVAIVGLLIAIRKSLRLEKVRKAILMSCKGAYIDVYRKYAMTDPQHGMQFEEFNRLCADVTGGRLQFDITDLGIIYNALDDHQKSAINEREFSEWMTG

SEQ ID NO: 583 - protein, 204 aa, Neospora caninum
MLPASLLGRASSFVPSVRCGFLSGTKRHIANLPYHSQVPSPPPREYNPDGSPKVYRLNQISYDHSYDWERWSFLPVGVFHTAYRGVFARDSRPLQAFLLQYHTAVIAVPIFLLITLTTFVFCSVGIYGIRPKRFTIEWMEASKERDRAENSNPCTRYLDRRRKERGPNWIVEDFLPTHPFFLNMGRFHSDTEYHKWKASTESEE

SEQ ID NO: 584 - protein, 340 aa, Neospora caninum
MTALASDSLDFLWPGSRILAVGDLHGDIGNTMLLLYGAGVVDEDGNWIGGDSLLIQTGDVVDRGPDGKRIYDYLSTLSAQAKERGGKIVQLLGNHDVMNVCGDFRYAHPAETMEFGGAAGRRQQFMDDGHYGKMLRSFPASIKVNGVIFAHAGIPSEFAAVGLGKLTQQLHEELADDCKLHNVRFYNEAMGLRTGDLFVAGSHGPLWTRVFSMGQMTKICEELEKALGILESEKMVIGHTVQESGNIEFYCDGRLILIDTGISRYVANSPRMLEIQNGAFFEWRLEISEQVSEGEPSVRGTKRPLNIPALKEPDSTATRTDGSAAGHEDKSDGSCRGDEL

SEQ ID NO: 585 - protein, 229 aa, Neospora caninum
MGNTMSCFDRWGKRAPDGPLLQIKSSESGGSSGIIQAASTASTAVGSTTTAPAATGGATSPGPAAPVPERPMRRRQTYSLKAKKSDTEMSSMEELSEESESDADNDAVSASDIRMKKVMQYRRALTKVVKLKTHLFSETVKVTCSKDGEQVQWFKGKTAAGAQDRKKPSGSFPVDKITSVKSQADNTKVLVITVNNPQPSTYNFTFKTPVERESWQEQIQSLMKFMAMK

SEQ ID NO: 586 - protein, 191 aa, Neospora caninum
MTAVEEQKHLSASSVDSESDEECPKLEEVNQEEDAGTPEGRSKQSRNEKKARKAVLRHGMKHMPGVVRVMIRKSKHILFVVPKPDVYKSLASDTYVIFGEAKIEDLNSQAHSAAAQRFTQASNAQFPFNGAASAPAEAKEEAEGEVDETGVDPKDVDLVMSQVECSRARAVAALKANNNDIIEAIMELSAN

SEQ ID NO: 587 - protein, 375 aa, Neospora caninum
MSALAGPLCPPVAMNGAEGPSSGLRHYYEQKIDGLQRVINEKSQDKRRLEAQRNELNAKVRELRDELQVLLEPGSYVGEVVKVMGRNKVLVKVNPEGKYVVDVAKNIDLSQCTVNTRVALLNDSYRLHKILPTKIDPLVSLMKVEKVPESTYEMGVLLYGPPGTGKTLLARAVAHHTDCTFIRVSGGELVQKYIGEGSRMVRELFVMAREHAPSIIFMDEIDSIGSQRTEGEHGDSEVQRTMMELLNQLDGFESTQNIKVIMCTNRIDILDDALLRPGRIDRKIEFPNPNVDARTEILKIHSRKMNLMRGIDMRKIAQEMNGSSGAEVKAVCTEAGMFALRERRMFVTQEDFEMAVAKVMKKDAEKNMSLRKLWK

SEQ ID NO: 588 - protein, 396 aa, Neospora caninum
MAQQGGFCQPPGSPVNGAPPNTIYVPLINQTIRRNRIVEIPEIHVVEKLVPKIQVQDVIRKVPRTDIQWVEKIVEVPQIQVIEKIVEVPQIHEIRREVPRVEVQEVVHRVPRYHVQNVEKYVEVPQIQYVEKYVEVPQIQEVVKYRERVEIVEVPVEKIREVPRIEVKVVEKIRHVPGPIEYIDVPQERIIEKPIYETIEKIVEVPEVHDVVVEKPIMVPVPGPEVEVPVEVPVYYDVPEYYPVPARVIPVEKEKLYEKLVEVPVHVAQESIRVVRVPHQVPVDVYKEVPVPRYVDQVVEVPVQVPVPQPPPIIHPVLQNQIIEEEPIYEQGPPRYIYETPVWAPPVYDSSSRPPPIESDPYLPPGGFATAPPHVRPAAQSMSHECNSQSSPGFQK

SEQ ID NO: 589 - protein, 536 aa, Neospora caninum
MVSIVNAKADVLRSAAALAANCNAAKGLQEVVKTNFGPHGTLKMLVGGAGQIKITKDGCVLLHEMQIQHPTASMIARAATAQDESTGDGTTSSVLLIGEILRQSERLVFEGVHPRLLCKGFDKARSKCLEVLDQLKVPVPFSPLPDRELLHSVARTSLRTKLTAGLAEKLTPDVVDAVCLIAKPDESPLDLFMIEILHMRRGLASETKLIKGMVMDHGARHPDMPTSLKKCYILTCNVSLEYEKSEVNSGFFYSSAEEREKMVEAERRFTDEKVKKIIELKRKVCTPENGRTFVVLNQKGIDPPSLDLFAKDGILALRRVKRRNMERLSLCCGGNPVNSVDDLTEDDLGYAEHVYEQTLGEEKYTFVDGVKNPQSCCILIKGPNDHTIAQIKDALRDGLRAVKNVFDDRAVVPGAGAYEIAAFSALQDYKKEVPGKEKLAIEAFAQAMLSIPKTLAENSGIDAQESVLSLIDEYEKKRQPLGLNLTTGEALSPSVEGIWDNYLVKKQMLSIAPTLAQQLLLVDEVLKAGKSMSRGA

SEQ ID NO: 590 - protein, 395 aa, Neospora caninum
MEAKRSHGTQTEAAQKKRKGESSMVNGTEGSNGGNSPISVAAEDKGAVRHAIKSYNNQDWLHSRSAREVRILCEYVEVEDRLRMQKVLGTFLLFGSARSRSPEQWKKQMENAQERLKDPSTAAQAEADIQKLKRIEWMCAYWEKIKNLSGMLMKWIQTEEARQAVARLLREIPAPVGGSGHQYTAGDVASVTDLSEPCPVAICTGGGPGMMEAGNCGAASVAGGRSMGMGISLPFEAGLNPFVDDGLAFEFHYFFTRKFWMVYTALGVIVAPGGVGTLDELMEVLTLKQSGKMKRDIPIVLFGKKFWKDVVCFEKLVEYGVVAEKDRDQLFYTDDETEAFEYLKQFLLTDKLVLGDHYVHKSLRHAAAGSRATTSQGASPAAATQRRGADYTEAI

SEQ ID NO: 591 - protein, 351 aa, Neospora caninum
MEESKRLGPSAGHAQYGTVPSGGARAVKDLEAQAFSVSPDQTFYLQLGGLLVLWYALNVMYNLDNKLALIMLPLPWTVSTFQLFFGWIFFCFAWATGLRPVPRVHTAELFFTRIAPQGLCHFFVHIGAVISMGCGAVSFTHIVKASEPVLTALLSGIFLRQIFTWQTYLSLAPIVAGVIMASVTELSFTWMAFWCALLSALGSSSRAVFAKRAMADRKQVGENLSSANMYALLTIVASLISLPLALFTEGAKVLAVWEASTGPDSPWTGPQILAKMCFSGFWYYMYNEVAYLCLEKVNQVTHAVANTLKRVVIIVASVIFFHTPVTTLGATGAVVAIAGTLLYSLSKTKYG

SEQ ID NO: 592 - protein, 334 aa, Neospora caninum
MKRSSVCVLVLLFELVKGGCNPLIPGSLPACQVTEGAILRRIREFFKPKLKMEDSSDESFSERDEDDNADEVSRSNHNYGRTTSTTTTTTTTTTTTTTTTTTTKDPGVWEEEEDSMSVPYTPLPPLRGMGTLGLAIFFSLVFSLKKIPLAVGGLGVLQYIDSVFERMQARAAMQDAYKRFESRRQIVRARRRRRWIQTFYSLRAQEQDRLQNQQVDEKADPATAPASASTQAGDETVPATDGTPSPATNPEPAVTRGEVDVESAAVSSRLPQMAKQGRDQLADVPQAAKAEKQLHRSGSDTVRAPVPEAGDASMPASPPREPRREKKNLQQTRR

SEQ ID NO: 593 - protein, 217 aa, Neospora caninum
MAGTTQESLQGLVDSPDGGRSSATSESNLASKSSLFWDVCTTRYSKLFDEEEAKHFQSSATCLMLQWVLNILCNVGNFTLAFIINIHPECLHGQFSWTTVHTSINLVVLSVSLLLGVAGIRQGSSAKLFQSCAGHLLLSTYELLLCVRDLCIICFSMEQDRLYVYFRGGAFQRSLFAGVCATAGVSCFISLLNAYKLRKLMNLLHKALPAGGFAGQA

SEQ ID NO: 594 - protein, 320 aa, Neospora caninum
MASSGFSPSLLKSMSSVDASNGAMNGEACGRGPCMRGVLAQPCRGHPNVLLFASYADGNECALVFIAGLTDGMMSCPWIPQLAQAIDRVGFATIQVNLSSSFGSCGMSSLQQDARELEVVVRYLRKEMRMKKVVLAGHSTGAQDIVSYLRHVNASPSPETKIDGAVLISGISDREAFSLMNGVVGKHLVEEALRLVEKGEPDGVLAERVMGCHFTAKRLLSLTQRLGDDDMFSTDLTDEELTHILAPLDVPCLFIYGEQDEYVPDMQRLRKFADLMITVVKKRAPQAGVVFLPGNHAFAADSDSNAMISAVCKFLEGFAA

SEQ ID NO: 595 - protein, 646 aa, Neospora caninum
MAAVVGSRLGGRPQAVAYSALWGSRRCARLRIDPQVEYRNLRKVLSSTKSPLLLRFLNVSSAKVDVLASPVHAHRSAAADSSSPAVSDALMAANSLRFNHEGKTASRPDGGRAASFRHAATAPVVDAEQFCVSRNAAWWTPRRMYTEARGQIAAVAAMQDPVEVLNFAGANELASTYLLVSCLRRVSALCDKKHAVLESVAKDERLHRLIQLITQHLDDCDGRCLVDLCWAVWGFRAAPEAVEQLLNRMANVVVRRENAFSPKQLGTIAFTFSWFRGGPTDTVADFVLAECVKLLPEMEPFHVTLLFGSLRRMRCLNRDVANLMIEKLTDDIDRFTSDDVVGVLRALAANSITRGFLLRRVATLVFDNLDSFKPKQLASILNSLALLRFLTVENGEELYSCLSGSLSELPSASLAEILEALTILNFPRSEAARTCIDLLAEKNGPVSQGLWVRDHMIIAAHAVIQNQLYDKNPVVKPLLEELFRSRVNSSRTHHRVEEVIHALDLEKASPSVDVPPQWRAMVDQANREEQARLEHSGLQNELTLVLDSLRGKFQLQIQKNQQAGPYNVQFLDDETKICIEIDYPCCRTPHIIKARHLKQLGYHYLLVDCWQWRRLRSEAEQTVFLKQLLSGPLLEVGRLEGVEPDN

SEQ ID NO: 596 - protein, 1277 aa, Neospora caninum
MDAAGQGGNADSTYATFLLKPREMATPSISTFQLKNGCDAHAEFDSRQQSGATRHSTCEPVSAAEQRPVGGCAGGALTVASESPSYQEVEKSLHALTEGERENLAAIAALEHRRTALAKAAERIQDVIEQSRESGQTEVMRAAEYQLQSIYQKQQESQALDQLPEQNRDAGGRAQLSIASDNRQDETQVGRELPRKSVSGTLSVKQQTDVYQGSQKIVVSVAGSPRARDGKFAAEGIAKKTETLQQSNKAVLTAPRYETDKRLASQSPSSPRGFSHDSHDMKHALAQESRSAAQRSSTRWKQQVVNLLRLPGPNLTREQFLSAFYHPGTSMSESLLMTVFDQLKNQSRDVTGAATEHVSIPVVLDVLEKHNGGDIVRLIEAAELLEMNIRNVDKKCKNLAKSPLHEFTRRCTCRFLLNLAKKAYAEMETTSQRFAPAVAVAGYSHALEGFQYALTKSLAAEKNLTLEQANVVVSKCIHNMRNELETDLIQLRRMEIQAQAEAEEAKAAAAARARLQKVTPQEAEALGIPYSALLQVAGSPEGVPVSGGTSRSVSVPGPAGQVAVTYRYPDGTLVTDPAHLPEGARAAELAAQMEIQKTASLAAEAARRAEEIAVAQAASAAQAAVSAATFGGALLPPSLTSILPNAAPGGSAPSGDAKDANADKTGSRMGAPVETPALRGMSTPGNPSTGMHLLPPPQQSGSYSTHLQSCLVSSEADARRSVSPASRRSFTGTMSGMLPGMEGMRPQSSPFPLGYPSQESRMQSAHMFAGGQQMANMFAQEEAMKGFREGVGASLTVPSAVSTPKGQLLSQLPPNGVPGGPPSAGSLPLRPGLQTLSMTENRDMFRRTKAPAGNQNVGGAPAASTRSMSLVDPLRQAGKLLAGALGLWKEEKGAGNEESGTEEDKHQMPPEEQTTTQAQQNGAFEQMRQNELMKTRALDAPQHLSLPEMPQGLPVPAGAGYAGSPLAVPSAPGPNTAGMAATYYSSTLPSTSTGVCPPRQLPSQMHAPDSRGHSGAYHGETLRHEGFQSAPAPAGNSYSMASVYQRPSASAVAAVLGRKQADSGDGAMPTCAGVMESSTGHSGAAVTQTSPLFGHAQAAPSASLSSVASTAGEDSKECRIRVSSYQEVPRPQLGKQEVGNLQQVQAQLEQLSLAHLEEYAKKFGLYSTPEEAAAALGGVPLQGVGALAAGTPATAPTGSAATMGAAFWGGVKTDGSHFMPKMGGLGDTLPYQMGHRGESGGVAGQRMVSAVREGEPMSQAQQRVVMVRQQYPGHGHN

SEQ ID NO: 597 - protein, 591 aa, Neospora caninum
MEKNQQRVKRRLASAQMPAHDGVEPAKLRAPAALDPCSPSLMLTDWYQFSMLYANWEAEKHHQHAVFEGFFRKAPFQGEFAVMAGVKQVVEFISRMRFTEEHIAFFRTQFPHASEEFFDYLRSVDCSDLCLHAIPEGTIVFPKVPLIRIEGPLAICQLIETAVLNILNFAILVATNAARHRLAAGWDKVLLEFGARRAQGPDGALSASRYAYLGGFDGTSNTQAAYLFNIPLKGTMAHSFVTSFSSFDQLKRDLVMPPPTRGAGAGEQPEKEGGGASAPRVVLGKDLIEQVLKYREKVVALWPAENLDSMMNMGELAAFTAFAQTFPNAFLALVDTYDTLYSGVPNALVVSAALLACGYQPCGVRLDSGDLACLSRDVRRLFHEAAAAFEMPALCRLKIAASNDLNEVIISSVRDEGHEIDIFAVGTNLVTCQAQPALGMVYKLVELEGNACMKVSQVFEKASLPCKKEAYRLFTKDGSPAVDLLQEAKDPPPAQGERIFCRHLYDDRKRCFLVPSNVKRLLQPYISRGKLVAEPLSLEDARAQCISGLRSLRKDLTRLINPTPFKVSASEDYFTCFHRMWQGMAPVRTYE

SEQ ID NO: 598 - protein, 765 aa, Neospora caninum
MAQISPCRAGPRAPAEKTSGECSGRLPGRVWQSSLGREKRRADSWAYGGFPSLSHRQAAALYPPLLLGITLLFAAYGVSPFVQATPIADFEAFPLLQYETSASNTPGSPKAAPVLLGAWGSSALNSALAVATIVADQVGSAGERGATEPQQQTGGEGATGVASGVLDDDGAASLLQQPMIQEQLRGLAKKNIYIFRATEVPVVLVDALLDRAQNVLLLLPPRGEEETDGDSDALSLASEDRPGKRENGEGEGNASRRPHMPALREAARVRSLEQRLISRFSAGACLFAFETPQLAALYEELRDHQTRLLASPGSLPASSLLPAFLHRGLAPTLSIQRAPLPASHFAAGLRDSIRLSAPFEGRNMFAWLPGRRPQEDGPAPAVAIVAHYDAFAAAPHLALGAEGNGSGVAALIELARLFSRLYTGADQDGSPTSANGGASPIEPGNYSLLFLLADAGGADFAGAAQWLAKTDPRVLESISYVLCLDDIAASPQLYLHTAKKYKEPRVRKLLQNLEKAFVQAGLSLSLEPRKIVVRTPPKPFWVHEHFTMKKVIAGTLSSKPHATGLWARSSILDQSSSAQSRANLLRVVGAIAEGLAHFVYEVEDSSVKIMDGLNRPLAPFLHAWLGRASRSPRFYAFRQTDQNVARKNHTQAPSAAFADALHAALDKLAPPAQSQTFSLPASGTVFTYEPPMFLSVVETRPAIFDILCLLAAVAYCFTIYYSIVGWQLVLPAISNLTSSGTAFFLDCLVPLLCFFPSISIQVFSS

SEQ ID NO: 599 - protein, 607 aa, Neospora caninum
MSTRTPYQDAALAIVKGAACIALSLKTGRTTRNVKFSKDNKCSITLGPVDNQPTASEEELLKTLTQQKIEENCPFRVFTIPREVATRMYQESYLDEFGIPANVKEVRLVVLPEWNINANIYPTLKSTGQIAEIRFETVKFVAEKRQLCLTLQVVPADNGDAPAVAVEEKVAPEDLPTLSQVLPPSGVEGDDLGNDGQDDQTVTPWDVQANEGGIDYDKLLKKFGCSAITPQLISRIEALTGKRAHHLLRRGIFFSHRDLNLLLDAIEKRQANLASEKREDGAGADAFSGPAFYLYTGRGPSSEALHIGHLVPFMFTKYLQDVFDVPLVIQLTDDEKFLFKENLTLEETHRLAFENAKDIIACGFDPDKTFIFSDLSYIQHLYPVILEIQKKVTYNQVRGLFGFVESDNIGKSAFPAVQAAPSFPTAFPMIFGGKKDVRCLIPQAIDQDPYFRMTRDVAPRLGLLKPALIHSRFIPALQGFKTKMSGSVETSSIYVSDTPEQIKNKINKYAFSGGQATESEQREKGANLEIDVPYQYLTFILPDDDLLKEIGEKYAKGEMLTGEVKAVLIKELQALVGGHQERRAKVTDDMVRQFMDPFRPCFQRYAK

SEQ ID NO: 600 - protein, 480 aa, Neospora caninum
MGASVSTARGTQALSALAVATGAAAIWWLTRPNGWGSQKTGALGVGLPSEEETETAMKEICEDFHAIFTELAQVSRNVIRAMQDQGFQKPVPREQVEAMLMQQMFRERLTVAEAAVLARKRISKESLERACDLYKDKNESVQVYIDGLKAMYRDAVDGELPMLPGMTLPDEVTEDKILLVLEQIHNAKQARFQEVLRTGTVSVRLKQLLDEMHTETIMALMNKRKKMASPKQQRPAADSCIAAALHPKVEETTGEELPLRLQSCADCGGCVVCLILRGEGGENEADVNPGAGADGKEVKENAPRGGIRSLRELGEFCEAVDEMDHQDISFVYLTHLEARKMEAEAMKTAASKAEEDGAAYVFFQGADLYTAAPTLADLVQTVQKEREKFSARRSEDPQGEERNVPACDSRSSPAGTNARRSSLSAPGTEEPCNAQTTEDAEMMPSANSVDMSCPASEGVGVNGVTLNGGGSRKTSMTLLA

SEQ ID NO: 601 - protein, 945 aa, Neospora caninum
MEGRTQVLNLRLRWVLLLSIFLRWQQEISFVRAGDPRWENTESARLVFVSNCREDSVKPCGTVEAELKFPKELGTVLTVGTLTQRFEHLLSVGPNVTNKPKPKGVAVTTWPVPPSLFNPTRWLSLRRLLKLPSPFPATQTLDTLRGKTLLVHPLVHTLDDYVTHSQIAVDTSFLNLLPKTGYPPIPTLWMFPSSFTPTTPAHSTSEGGESLKTARDADASSSVPSLTVLTLLGTSPFVTLQSILTSYASQLKVTTQQLPNNPQGPGEGEGEIRIHTPTADKLARLFPSLMYFPLKFLNLENPAAFQIDIVQLHAFPTSLSSYLCTSVEKHLFTEAGLIDLEIAASRQFLVQDGEVFQPLQAAFAARRPWDTNEEQDPTVVLLQWWISEDGKEIWTESPLSWSFPDVDNSTVQEMADMEEAFSMADVVAKHSGAQFNSLQSFFMRPINVEAFRTWNPRAFVASPADAVVQNIITVKPKPDGYIRDAVVPQVKSTTFDLMRFLFGGSAGNNAGIKLNSTDNRLILSIHYLSPQDYHRFHSPADWTISESIYLPGCTPSVNRATLSSRDGVLHHYERTNLIGHWDPLARGEKLFFSVALVAARFVGGLSLFWEEQPLKPRGPKCPCSKADVYGSESKAHDLPVCMGQELGSFRLGSTVVLAYEAPMDFDPTLLGECARASVLQPAVVSRSGLRRPLLPRCAAFATNYESPLHYLDAIKENLQFGEQLRHNFLLPPKWRKAGRARAEKIRAIERGLIGRFALSKYLFLFGEQILGPKAHLLLAQPFTLSQAGGEDKLGRFLPKCYRDSNSINVELTGRLSTVSLILPVNGNEKLLFKHPFYGCVGDAALGKVSRGIDAIWRLHGSHLQVELTLTVGTVIGSEPRKISVAENKLVMEADCNKNWLNHAPGTTVTACMLQSMKREVDSNPKLTSLKNRDLWQAYKGVQSVS

SEQ ID NO: 602 - protein, 1007 aa, Neospora caninum
MSCKLREFIRNIRAAKTAADERAVVSKECAEIRTAFKEGDGRYRHRNVAKVLFISMLGYPTQFAQLECLKLLASPRFAEKRVGYLGLSCLLDEQSEVLMLATNSIKNDLQHPNQYVNGLALTALGNIGTAEMCGAIMTQVEDLLRCSNPFIRKKAALCGVRVVKRVGDCEEKLLACLPALLADRNHGVLISACALITALAERDPGLVDAMRTHIPCLVKSLKACLTAGYAHAAEYDIAGITDPLLQCRLLRVLALLAKGDEASSASLSDVLAHVATNTEGAKNVGNSVLYECVRTIMTIEDDPGLRVLGVNILGRFLSSRELNVKYVALGTLQQVVRVDSKAVMRHRDILLDCLKDQDLSLRRRAVEVIFCLITDDNVRGLVKELLNFLLMLNDAEFKQLVVNKIAVAASRHAPTTRWQIDTLFKIMTLGGDAVDDAITFSFIDLVVSTPPLHSYVVHKCFFSFQHSLSNNVALWQAGVYCIGEFGDLLVKPEKGHLLGPNGSGSMTEESLLISPRQVADLLLSVADQLSSLPSSKHVVLTQTLLTAAAKLAARLPSERERLVGLLKRFEADSSVELQQRSSEYVGLLESEEWKENTSIFDRMPVSDASKLSTRRSISSLGSGSSSSLLSGRSGSAEGISPAPASRPVGNVWFDATEVPLNVGSPVAGFGEPIESSEKDERSSPRSPQGNAFDEKSPQRNGVGAGSTKTDLLDLDDLLNMGYSSESRVSPQTASPAAAGAGSGAGDALSGPSSADKNIDMLADLLQGTSVSSPSGGGARVGPSGAASSAGDVRGSSPGQDGSLDSLFGISPSQLPLNAGAPASSLHSPTSDPFDSFLVPETRGGPSNIVVTPGPGVLGSSGSGNGASPPMNVLNEDDLCVDFICSRQGPGGSSAAAVPELLEKPRSSEGASIRAEFRNRGQAQITNLLFEAAVPKYLKLTIQPATGTCVPPNGAGVVTQGMHVCFGDGAAALGAKPLLMKCRISFNKDGVVLQKFVNVGDFPSGLLS

SEQ ID NO: 603 - protein, 805 aa, Neospora caninum
MAETAPYYRDLTREHAPQPHRPQQPSPAPPASSSQVAVYGGSPQHPSEMFWMRNPQPFLPSRNADDGPEPLLAGPASFAVEAGRQPPSTYSSAYLNSMYRPPILSDQGTVFPPPLLGLHPAPPSLPSPGEVSMTALGLQTGEQAGDQNGAERAGAKNGLWTPTSSPYHVTAPSLPFSPFSIGGPGKRDRVRPGVHEPLTSSCPLCCGRPGTSSSFLGGEDSSSTFMGCYCSAHAGQSGGAATAWSRVASLLLFLLDRVRRSVSACSRVLGSSAGPRRCHASSASVFLRIGLAAAVALGVLLFVVRMHTAHRSGERSKAHRTVHPGLSVEERSIWDTSSVPHLLSQRDAQPFGGSDSDTNFLPGAEETDGDETDGEENLLLAGASTRLVHPGVGVRGKDACRGSDYISHTLRLAHEQSFFSLFSNTHGMSKYEASDVVGVNGSLYTVFDSSYAIGHTKYTLHPFDEENYLIGSPKRTGDDDSQWEGITYDEVTKHFFVVREAIVVDAHAPWKPKGADASPSEAAKETPEAAAQDSKGGKRKGSKKAKKQKEDAGHEQGEQPDTREEKATAAKPGHYHAVIEEIEVKGKNYTVVQACRTEFSFSSENKGFEGVVSLRNTNGTFYLLGLCEGNYCKGGAKGRKRGNGRLVLMEKVEGAEPGEHCLWKTVKILHLPREIAFTDYSSIAIRGNHVAITSQEDAVVWVGKFNMPEDKPEHSDGGAASEANIDTPTMLFTDPMALEVASGGKVLNFPRDEQCNIIYCNIEGIAFAGRLLVTVADKVKAWQDPRCMATDQRVHAFALPPNFKY

SEQ ID NO: 604 - protein, 1394 aa, Neospora caninum
MSSRRFAHAAAMEGPEPPADSRYSSGVAPEPQRGGGAPSRRGRGDFGRSGAHAFSKDAAASFASSRNGPSSTPAPGPQTAYPSGRPGPPSQPRRQASTAPHAVPSSPLCGSPAAPVPAAAFASVRDQPDSVDKLFGGMGNPQFNKYIVDDENLLHFYGIRQAVLRPVVHEDCSRGGASATPSPSPPKNARRGKESNQNQFFKASLSWTIAGNRKIQTEGIGRSKKDAKKEAVKALLGQLGPVTLHEYEQVTRCLFASLRGKIHGKQASFPGGNEHRFMWTFMSGGEEVRIESTGRGNSSCEAEIAAMQDMYLKVLKYKDCQTEEREKINRQVTQARQQQAAETRGKGNHGAHLSKQDAGEINQQHHNLTTRNQIKPTETIAVSAEGYRCNLEWRWTGRDGRSRTLSVVGIGSSKPLARATAALQMMADAGFVEHVEAPDRQAARSLLNLVAERPEGKVYVAKACALLEATTSAVWRLFLPTVWRMALAENERSLIDALLQTLKTVTASASDEASPSPASGSRAMPPDVWEMLLDECTVLTNCNFGQAVLHELGDVKLEQSYFPSPLARQYFQNYRLMLALEWQAQLAAGIEDRKAYGDMFEGKHMVLNCKSAAMPVFSLGTTLKAEDREFLANVQFREDDCVLLRPFEEQRNSEDSWRKCFVGVVTSVKSDSVNFNVNVRLASGEGAKHAAILTCRRFKLYYLTPAVTHDRMVEALRSLTMHRMPVSHSTSSYAFTPEIRYLLLHTGEPPAKDVAGRGPVPLLSDVDPSHFDPLHRLNELADAQMFSAASFANRDEAAVVGASALQHTKKQRLQQSYVAANNPPSLLLSQVALQARNQLASDRNDFGTPSPETDLTDVVLPTGLPLTRPQKAACLSALTNRLTLVQGPPGTGKTHVACAIIDAWQRNDPSKKILAVADSNVAADNLMEGLSARGIRSVRVGNGSESDLQEEAIADLGRYRDYVRLKQNGMYGEAKTVRMALFREAIRRQPVIIATCVGSGHEMFDDLVFPRVIIDEGAQAIEPSNLIPLARGCRNFVLIGDHKQLPPTILSPEAASRGLDVSLLERFVGSGIAPIQLLDEQRRMHPSIAYFPNLQFYDGKIQSRDVDDRNRPPVAGFRWPSQNSRVCLVDISAAGLSGSEASQGTSKYSAAEIDPIIAILQSVANEGSVLPSQIGVLTPYDAQKARLRKAINETFEPPACYQIEVDSVDGFQGKEKDLIIFSAVRSNARGEIGFLRDPRRMNVMLTRAKRGVIVVGDQLTLWNDATNWRPWIQWVGSMRSIVPITRLNDHLDAPRYALPAQGAPGGNLPRSASFAARQGAGAARGGGAAGQVFVPQGFQCDFHTTGASQFDRTFAQSQSPAKKAAEEEEEREVRHRGNQREGARRGKRWTDWTD

SEQ ID NO: 605 - protein, 578 aa, Neospora caninum
MLLSRLRNTAAAALVLRTNASTPVSPLAFSSPLKQTLGKTSVCPLLGASPAPASFLSGAAGAVVARAQAKTDCRFLGGAAAQAAATRKLFGRVDAIFRRNCSFRSLSTSSRSLCGGLSEAEAGAAVEAALDALALKIEDAAGPKRELLKELRKEHGNFVVSEATLNSVCGGMRGLTALLTETSTLDAEKGILYRGLSINECLAKLPRLDKEEYPAVEGLIWLLMTGSIPSVQEVQLLSTALYALSLSSASSAPSPFIPPHVGKVLDAVPPSTHPMTQLVMGAAALQSTSQLAEAYRHKTVTRHDLWKPALADALSLIAKNAVVAARIFRRSFRDGEEIDPQRNLDWAANFGHMMGYDSEKHCELFRLYLFLHADHEGGNVSAHTAHVVGSALSDPFLAFSAGMAGLAGPLHGLANQECLNWLRDVHKKLGGAAPTRENVKAIAEDTLASGRVIPGYGHAVLRVTDPRFTAQREFALKHLKDDELFKLLDVAYNTIPDILLATGKVKNPYPNVDCHSGVLLQHFGITESDFYTVLFGVSRAIGIASQYVWSRVLGLPIERPKSTTLERLKAACLKKKGN

SEQ ID NO: 606 - protein, 784 aa, Neospora caninum
MERQDPCLTASSGDLYAVNVSPLPASASAQPASTMSALQFPPQRACSPPRPSFLRRRSARIHLLSLLSLAVCGVFASLCCMYTSALLRDSSRVSPSASFASSACPSQQSVSPSLAASPLPSLAASSLPSLASIPPVSPAASPSSAVSSPLSAGGLVEFSSPASILSYPSSVFSRLLSKLSLSPATPALFSRQADSPSAKAEAHESSLWTKLALENFPEGSWRARVQSAAVIVKRQVAQQIRKHQPELRRLVQGLLQMFFQCLRSFLGVYILGLSVLILPFCASSASRFEAAVNRVPLNDPYLLSQLDLPEDASPSLFGLSHYDVTIAPVPPAQLSALYAEGEGKGGSDRARAPSKDGAPPAFAAGTRESAPQELPTADLRGPEAEAREARARGTAGTERATATDGRRHGIADGNLRGWWIPAEDRNSKKAVLCAHGWLANRQACLPFLGVAKKVGLHKDHHFLLFDLMNSGESSRLPECALEDGTAGCTSSGEHSADADGPCSGGRSWSFFTAVDDAGDALLGCQAAKDLIQALLWMKTHGISTVSIYAQGVSAMGTMLLVGQYREHLERAVGIKIDRVVFDSPICNARDAVAKQPMTACIAKTAKWLHDVLMWAVNQRRGQELRRMRASLLLPASQPLRKLVLTSREDDLAPWETVEKEMMLLPEADRPEWTCVFPSGAHCDLIRTNPEAYSQVLRAFYSDPSFLGRLWEKIVGKRAPVSALSGVEALGPHDFTLCAEREEREREKREREKDKALEAETRAKLGRKKLAIAAAASVLDVLSSM

SEQ ID NO: 607 - protein, 424 aa, Neospora caninum
MPRLRSLDGRAFLNVAAEAPVSSEPMHLMPGTSSLSRECVSELQDRLQETARCVRSAGTVHPKRSSTVYVGAPGIAYAFLKLATLQTGDQKQASRDTAQKLLGPTVLESIVEQAKRHRSLGPSLLCGPAGVFMVLALQAWQPGVHLASQSAAYLDAVQSYKQYSEYAIKELDSDEWLYGRAGYLYGCLFLNHLAPGSVSETTVTQLAMAILESGEAFGRKTGGSPLMYRWHDKQYIGAAHGLFGIVYILMLVDSVRNDPHAMRLVKSTLEWLLTLESKNHNWPAVVGETGDYLCHFCHGATGAVFAFGLGSIVFNNREFQKAALRAASCVWKYGLLKKGPGICHGISGSGYGLLMAYKLTRDPVWLDRAADFALKMFDEKLQADSRVPDNPFSLFEGLSGAICFLVDLLKNPLKASFPLFELGF

SEQ ID NO: 608 - protein, 753 aa, Neospora caninum
MLLRQGKIEALTDMRLGVDAVFWLRSLASLKDPLAEAIGGLPPSLFAVLSQQVALFKEHKIPTFFVFQGLQPRSHTLFSSQIHQQIDEGWVLYAHGGGQVALSKFAHATSRINSDLVHFSFHFLKSKGCECFQAPFFATAQLAYFAEQNFLDAIFGPPSLLLFGVPRVIVNIDWARGTFDWVELEQLLTTWNVTKEQFMDACLLAGTEYCLTFPYLNLSQFHQGRAQFSFGTAIDFVKQAPLVSYMQHFPNEEMKQDHVDGYCVCKTLLQYPLVIQLSATVGPFVSSSAGSNQRSVLPRDFHRIVGHRLPFAVYFLMAQGILSRKLPSVLALGEWMDFSHPCVDSIEYRDLLTDVREYRCRALGLIAMRLHEDYRTRSIRFSRYTCSLSARGDSEVESLPPKIDGTVARCWLIDAESVQKEMRRQNCTKIDLKFCLNWHTHAQENGVALFDERADYLAENAPPAINQQDSQSVLALVHFMLLDNLSYFTEQGETTVFGSALMNSPSELQEDVLFVLELLKFGLLTGDVLEAPKDRPHPAGVQLLRRPDTPAEKRRSILLLSRVCSLYPMRLHAGSHWQGDVDFDLAAYSSIIKILKRSLRQLTEACLASLLLRDITKVRQLPEGYFSPLQPRLPCFLLPRNCMGIVMKFFLEYVPMEGPVAASAPLPSSSIPQNSPLGKFEACVRMWYPCCENPLSDLCKTVLFWHEIANMINQLNSSIDVSELKEDVDAATDFLMRQCRLVGLDTHPDFPRL

SEQ ID NO: 609 - protein, 82 aa, Neospora caninum
MEIDLLNPDPKVEATKHKLKRLIPNPNSFFMDVKCPGCLQITTVFSHAQTVVLCGSCNIMLCQPTGGKCKLTEGCSFRKKVE

SEQ ID NO: 610 - protein, 143 aa, Neospora caninum
MASSLPHPPSANVALSFTSAPADPMSRAEAKGANIRLELQSIERELKDWWMSRKILRDRNIGLFNLLQHHNFVGLSINNAKMSDSQRVMWTELVQGKPDLEDSLSVDAREMKVDMYEKMFKQAADLENPCRIPGATVVVPQRV

SEQ ID NO: 611 - protein, 260 aa, Neospora caninum
MATVRGGERCSALAPSCSRSGALAAQTPGSFRRTAALRSAFVLFLSVFFQCTEAVLFEVPGNSRECFFVPVNAPRTNINGRYESFRGSERIRVTVEGPVVPPDPDQPKPQMTSQMLFSSTKESSAFKVQLPASGFFKICVGNTLSYAQTVTLNFHVAPSSVDEGSAEPGSSKRPPDVNQLVMSSHTEELKNLSDKVLEMANGLFEQQSNSLARMAVHEQLGTSTRNRASLWKVIQMCSQIVLSLVHIYAVRSHFEVKTIV

SEQ ID NO: 612 - protein, 246 aa, Neospora caninum
MSYDRAITVFSPDGHLLQVEYAMEAVRRGGCAVGVMGKDLVVLAVEKKAAARLQEPRTARKVVMLDENLCLAFAGLHADARVLINKTRVECQSYRLNTATAPSVDYIAKFIAQVQQKYTHRGGVRPFGLSCLIAGAEHDGSIALYQTEPSGICAKWKAQAMGKNYKTVQEYLEKNYTPDLDEDAAIQLAISALMEVVEAGHRHIEVAVVKKEQFYFLDEDRLEKEAQRVESLKNSEEESKSSGGSS

SEQ ID NO: 613 - protein, 310 aa, Neospora caninum
MGKDYYKILGVGKDASEADLKKAYRKLAMKWHPDKHADADAKKKAEAQFKDIAEAYDVLSDKEKRQIYDQFGEEGLKSGGSPTGGAGPGGPRANFVYREVDPSELFSRFFGSDRMFFGGDDDFGPFGSVGMGPHGGGFPFRMHHASTGGFGSRAPSKPKTYEVDLSLSLEELYTGTKKKLKITRTRYRNGQMVKEDNVLSIDVKPGWKEGTKITFAGEGDQDAPTSPPGDVVFVVKTKPNSRFVRDGNHLIHKVSIPLVKALTGFTVPIDSLDGRSFKVKVDTVVTPKSRKIVPNEGKFGMEKRGREPLL

SEQ ID NO: 614 - protein, 307 aa, Neospora caninum
MEVGILRYVGRLTVLLGLVACLIGTVPQRGSCDVFGASLRGRNALASLFWRVRNAPFAESVVAKYSVFTSDDTEALTSLVEKVNMLGIGIQFFCEYISSLNKSQRAYVWGVAESTDAAQSFVNKYYKAQDLVGKGMASGDILYRIQYVLNGYTALPVLEGYSRFMADQFSNFRKGFLIFCSDVSDALLKHETRRLYRIFRDGLPLLTTCLKTLLTLSTRTTDREVREARVIVARGIDKLFQLDSTLLALSPNAPRELTEARRTLMAHGLRYATDARQGSGTVSGVPSSGRVNDSEGTADAVVGDMAS

SEQ ID NO: 615 - protein, 542 aa, Neospora caninum
MAEPQRDSKTFCPGPLEDQVPTSCKQAIPVFGCGSERVRLAALLDGGEASVEKFVNQEKPVTVCGWSRSVRKQGGGSLCFVVLSDGSTSTNLQVVVEAGIGGDFPQLLKCGAGCSFRFTGDVVKSPAKGQAVELAVRDPSKGHRLEILGMTDAAKYPLAKKEHTREYLREIAHLRPRSYLIGAVTRVRSNLAMATHRFFQDRGFLYIHTPIVTASDCEGAGEMFQVSTLLPPPPAETKENEKKADGAANGQAAAPAEPLVPLTKDKRGVDYSRDFFGRPAFLTVSGQLAVEPYCCALSDVYTFGPTFRAENSHTSRHLAEFWMVEPEIAFATLEDNMVVAEAYVKFCVQWVLDNCRADIEWFQKNQEEGLVARLENILAEPFARVSYTEAIEILKAEEPKAQFKEKVEWGMDMGSEHERYLTENIYKKPCIVYNYPKDIKAFYMKLNEDGKTVRAMDVLVPKIGELVGGSQREDDRDRLAAMIQAKNLDPKPYWWYMELREYGTIPHAGFGLGFERLVMLVTGIENIRDTIPYPRYPGHAEF

SEQ ID NO: 616 - protein, 318 aa, Neospora caninum
MNQPFGDFGENLSFYGSASYSGGAGAKSGESFGMISLDPSNPAGECAPPPKTESSSMQNLIFGKIFEGKGSGADTTFASTRSSSAFGSFTDKSWNPLSKPPRGSMDNVAAALAQAGRSGLPGQNAANAQEEQGLLASGMSAVKEGATRILGGAQTVVAATTQSVTESPLSTQHLLLFGLVAGVGVLFMFLAFLTLPLLVFAPAKFALLFTMGSVCFMVSLALLRGVTALVAHLSEAARLPFTIAYGLSLVLTLYATLWAKSYVLTLIFSVVQMLALASFLVSYIPGGKHMLKFIGGAAWQMVKKLCNCKDARDLQLPL

SEQ ID NO: 617 - protein, 859 aa, Neospora caninum
MAPREKKSERSKQPRRKGSGEVVADGGKLLHANAVDVDVFGSPGESPQRSPSDTTKDKGGEERAASWVETDAFGDAEAVAKPRRIGVTLAKTEGANDEGNKEEGAMKEKEEEHKKEDDATKEKEEEEQKKDVDTKANDKQGDVDTKANDKKGDDAIKEKEEEQKKDVDMKAHDEGNKKGDVDMKAKEEEHKKEDDATKEKEEEEQKKDVDMKAKEEEHKKEDDATKEKEEEEQKKDVDTKANDKQGDVDTKANDKKGDDAIKEKEEEQKKDVEMKAHDEGNKKGDVDMKAKEEEHKKEDDATKEKEEEEQKKDVDMKANDEGNKKGDVDMKAKEEEHKKGDVDMTRKEVREKTLGERTETSLTRETDGPAKDVETAASEAERAEGEAARQIQAAEVASEEAREAEQALAKSISRAQELQSELRAAPEDKSKEEVSERVKEARDALKAAKNEAEQKAVGDVKAIEAAESAAATAAKAELEDELAKSNGASPADEAPTFQIRVSPASSPEGAGEKAPVSEALLKAMAAVGLDASQTRDYLKAVEEEAASAAAEGKDSRYEGLASSHKVVARLEGNQEQVRLMESRFQEEVAVLREKFDRLMEPIFEERAAILSACPEEETPGSAGDSSRNDSLPVGTRALPGFWLRAFENNRLLSSMLGGSDKPLLLYLRNIRRVLNKDKEDGFSLVFEFGENPFFTPCTLTKTFKMKQDEDGYIVSKTVGTPIMWNENMDVTKSVVVRKQRNVRTKGVRTIHEEKQEKSFFLFFNDSVVPEDDELDAMSEAEQSAILDKLKLEYDAGVTLRDLIIPYAMDWYLGTAVDTLGYDDDEPETVQNTEVDNDSGRRKEDVRQEEDGGIASWFGF

SEQ ID NO: 618 - protein, 449 aa, Neospora caninum
MQGERKSEAKLEEQSSEGGNREGSGDDGFDVEILTTNHDRSRCFPATVDGRLKVSVYGRFLPRSIFGKAVALCSLLRMFWLVLVIFVTGLWLSAICLSLSSVVEGRWRRKVIFNDQVAAVNPLLSLFCEKLVFYAHFPDLHLVQRDAESTRLLACLKKWYRAVLDAAEAATTGQCGLLLFNSRFTEQTYRRTFPLMRFPRHKVLYPPVDTDAADAFRRRFCRAACVASLKALPEFKDFDFSVPFVFSLNRYEKKKDLQLAIHAVARAQSGFNSRLPENALVFEELLRTALMQSGFDVLWPAAPSAQSPASKLAKAKRTQVVFVKNIDEAARQCLMAVALCLVYTPFEEHPPLPVGPVRGERARLSGRCLQFGRSPRECPSRENGKWIKTGFLCEHDARSFGDAILRLAVMQREDPPMYEEMRQNGCRHVKENFSYGQCLTGLSSPFWST

SEQ ID NO: 619 - protein, 775 aa, Neospora caninum
MLRVRYSPQHPPLATLCVSVLLERGLAACVPDNKLQGSLLIVQKSDNAPEEFTTDVAAAKILCALSPKTLLLYPAAVPSPSFEDACATACIDAMLSLAATLQAASSLSPKQLGSLSSHLQLRTFLCGYHLTLADLAVYAQLRRLACTEQHAGAPPAGWKDKFVHVSRWYSFLHGQQSTANAVGVALRKAGSTATRAESQKNEDGKKKAERANANPSSPTAGDKKGTASHASYEGKLEGAVQGKVVTRFPPEPSGYLHIGHAKAALLNSYFAKKYNGKMLFRFDDTNPARENEEFESSIAEDLRLLNVEWAKISHTSDYFEEMQSLCERLIKEGKFYVDDTPAEVMREQRAEGVESCRRNASVEESLQRWAEMLKGSAEGQKCCVRAKMDMQSKNKCMRDPVMYRCVADCPHHRHGDRFKAYPTYDFACPVVDSIEGVTHALRTNEYADRIPQYQWVQQAAGLAPVHIYEFSRLCFVKTLLSKRKLKQFVDTGLVEGWDDPRMPTVRGIRRRGLQVEALLEFILEQGPSKAGNLMEWDKLWTKNKQIIDPIVPRFMAVGKDAVPVFIKGGPETVESKKRRMHAKNESLGEADLLLLNKILIDRDDAAMCENGEEVTLMHWGNCIFDTVVKNAAGEVTEIQATLHLEGDFRKTKKKLHWLANLSGLSAAPAQSAELVLRELDHLITVDKLDQEEGDWEKFINPQTLFDTPAIGDPLLRQLREGDLLQLERRGYFRVDQAGDRLVLIKIPDGRSKAMSAVGTKVDAAKLSGAKITGKK

SEQ ID NO: 620 - protein, 492 aa, Neospora caninum
MAGFFPPISFDPSDTVEEAFIAPPPNVMENKEILEEAEKRALYEDFASVGIMPDTYLSLDELLSRLRRSRQSYDEEMIRRIFCALSPYSVTGTNYISGRTFIESYMKRRRELAAVLETARAELESAERMLEQARTNLQHIERNPAAAIGEESKLTVQVVSVQNLEDTSVVSPPEGILYKVHLECQQQVIETQPAPMRQGSCYLNEIFSFEINKREGSLRLCLVRVDPYGGPDELVGDCAVLLDQLADQKKHEMTKEIWGHKGEILLSCQWIYSKKLLYNTYLGEFSVRRDVKLREISDYQIEADKLNKPFGTPEKATRGLCGAFASGPEYLSKLLDQLRVYLKLSSWMATSQHMAALTLCLSCIAGFTRPVFLDQMVSAFAFWNNIDPRRWTVHRYSFLMLCCAVGVFYDLWWMRIYFNAWNLRSVEADIHNITKVFSIFLCIWKIVHGNELSTATGAYIPLKVEDSTVLGLSSSVPRSAGASVYLAKGSDC

SEQ ID NO: 621 - protein, 541 aa, Neospora caninum
MEDSKPNFLPTPGLPVVAVTRPGVLSVADIDIPPFDDITQSASPVEETKMASVAVDVHSKPAGGLAKTAMDLPSKSKTSPFNPTLAYLTFMFVGANSLINWIFVMQTIPFIAHAFLDDQDWNNTLLGSFQAIEVVVQLAMLELGSTHVNVVCLTGVINALAGLLIVPLTLYTSKTVAVWMLHLVCLVLGACSGVYQGSGYAIASMMPRNFVSAVSTGQGLAGMFVFVVVIGASFAIFDVDTAAGTEGIVWTGFTISAILSVLCAASFFVVMRKSWAVSCLERVRAERRAKRDAARACKRNKAQQTPRGGAAESPSVESDGYTRDQSSAQMTMVTMLPPDVQEPRAAEKEEQGREVKATEGTEGPAGPFGVRPWPFVLKAALPWLFMLILHMFISFHLFPKVGPLSWNYENPPKNYLVILFGIFYVAEFIGRSLPDLCTIKGLGFLHLPRRAFVIAELARLLFFIPFVLGYAVSNVPFVNNFYWYCCLIGALSLTQGWLGTLAFYYAVNSVESPTERELTGPMAAIASPFGCVIGLYTAAPY

SEQ ID NO: 622 - protein, 619 aa, Neospora caninum
MTASWLRFLAGASVPLLAPARCDSPQSPPRTPKEQVAALLAQPPRPFSSFAPLSSWMASKWTNFRLWTGLLSAAKVSPFSAAAPGAAAPGQRRQKVVIVGSGWASASFLAGLDMTKYEPVVISPRDYFTFTPLLPSVCVGTLPASACMTSMRELLMRGGVPCGQFYEARVEEICPETKTVRCRATQASLKDAHEWDEPFDYLVVTAGAEVNTFNIPGVKENAFFVKELEDARRLKAALFDVVEAAAVPSVSEEERKKLLHFVVVGAGPTGVEVAAEIDDFFQTEGALHFPHLMPFVRVTLVEMLPTVLAAYNGSVQAFAKRLLEENPRVNLLLQTQVVGVKPNSVKVRTRRAQGAAGQVHVEENELACGLLVWASGIKSPKICLDLAGKTAELREAQKKTPVLLVDQQMKVRGCRDIYALGDCCRLLPPPLVEHAETLFEAAAGGAGTASTDWLEKEAPKLSTIFPQLARSKYDFSKKPRQTEMTKDQFVKLLAEIDLAYRAPAPTAQNAKQAGLYLAQTFNAFATPEEKTLAPAFVEKNRGALVYLGQGQAAADIEGWRTFLGGRATILLWKAAYLQMQFTFYNAFACLGGWLKTHFVGRAVCREHLDGETVYSDRRK

SEQ ID NO: 623 - protein, 1118 aa, Neospora caninum
MPQRYVKMKGVDRGRWPSSSPLRRSCSTRKLSSLSRRPSPTSLGSFCSSDSPTCAFRLHSSVSRFLLFALLLLTPVANEAIKFGVHDRHLHAEPEGNWNQTYKRRRARAPVDSFSDSRVARSNLNLPVADSEQAASSSLAAADAAHIEAGLVALSRTQSRGLWKPEVSAEVPETDTGDSRGSDEETERPDSQSPLSSSLPFASSLRSSSVSPASSSSLVSFSFPNPARPSDWLMHAVPAAFTEKQKGGGVPSGDGTDGKADDKALAFLGSAASASELNPPRLVRPTSSPSLPSREEQVRKAYALPLCEMSWDVLGPMLGAGTFGRVFPLKQPACTAVTKDFVGRKFAVKVFWLKRKGLINLFETIDEGAKPSAEHTDPDTITAIKSEIRSLPISSPSFQDMIRLADPKLDLEQIKAFGESLTVETVLKEAKALRTVINTNCFYTEVGETGTIFIQMEKFIKAHRASVWTTLAKATQEAQASKYAEIGLEENHWSLPLARVIVKDKKGVNHWALLIELFDGDLQPKVDKTGYALDGWNAKAAGNVPLREIFSSREALLGLTSKLVKPFVVMQNLYSLGHFDIKPPNLLYKYFPAANGRPARLSVAAGDFGMAGLLHSEMVLRGTLAFMAPEMERVSGGLVARPSFDVYALALTLAFFWTASTELRNHLPWVNKCIKPTLKSGTEFTFQRLASKSGPRIFEPDTIYALATCFAVGGKVEKLYHTGMPLLLRLKLSQMADPEPAARVSMRHARFVFKAFTMLDKLLRDVPSSANAERRENQLKQLQELHIVQFLLLYLRLEPLTAARDNTQSYWRLARALLDFARLEPIDTAATEAVAPLPFEVFAKEKDWKELKIEVSDDEVDSTIRKLRDSLTGNRSTSEEAWADLVDIAFGVSLEGLRTLVTRVVYSRKTFLVEQKIAKAVKGAIEAIYRFDSNTQLIAEDPPARIFDLVRAELGFSPPEDSEMGRFITHRTTKSFIAWATVDRLARQALRVALKRHGKDTQQVYEQFLAGEKPRAANAQAFYNAVFSSLEDVSQANYFGLPWDFATPSVFGLSAEEMQDYVRNTHLTYVAKMSLRSALRLVAFFLVFCVCAAERKVSKSPFAVFCSLTHEGCAPGAF

SEQ ID NO: 624 - protein, 563 aa, Neospora caninum
MSAAETAQAFKAEGNAAFQKGKYEEAVGFFTEAIKCTPDDAVLYSNRSGAYASLNKLEEALKDAEMCVKLRPTWGKGYSRKGLAEFRMMKYKEAEATYQKGLQVDPTNEQLKEGLNQVQQQTDQFFSMQAMLAAAQAVNRHPKLAKYQQEDPEYTQRLTEILKQIQKNPQSLKLIMAQPDVRVKEGVIAAMGGDLEEEEEPQSQSAAARPARAATETVSGAKAASKENEQPAKELTEDEKEAEALKQKGNELYKQKKFAEALEAYDAAIEKNPNEILYLNNKAAVYMEMGDYDKGLAECQKALDKRYECKADFSKVAKVYCRMAACKTRAGDYGGAIAMYEKALCEDNNRATRNALNEVKKLKEKKEREDYVNPELAEQHREKGNEFFKQGDYPAAKKEYDEAIRRNPKDAKLYSNRAAALTKLCEYPSALRDADTSVQLDPTFVKGWSRKGNLHMLLKEYPKALQAFDKGLALEPTNQECIQGKMTVLNRVQQLQSSGEVDPEQMAHSLADPEIQAILKDPQMNIVLMNIQEKPDLIHEYLRDPKIKDGINKLIAAGILRVA

SEQ ID NO: 625 - protein, 628 aa, Neospora caninum
MGAQRQLVAVIAMCGVCGSAGFPPYPVALLGEDGGRRWLPLHQQEDLSPPHAISFVQGTGGKMGMIRNLLQRVGNFFSKKKLATESETKTAIESYVKAKEGLNLECLQHLRLPLTQTALVGLNGDDALYRPRHRVLPRVDLSILDSKYDSISPLFKEMFGTSFSLSVHGKERIDGIVQKKQVPKLPQTKRRRLLVTLLVYILLDMRSMPQIDPLLLSLLMRMTTSSCGKQEKRKIKVNANGKTIKVKGIRIMLVAWTELVKSMVRIGGCSSSSSDANCALLIAYIQWKDRVTEQLNKVSVLQDHKTEAGSDGTESAVDRTVSDEEVQVLVDRVLHRIENNLLFANTMMKMKFRWLINFLGKRKSVRKMILKFSGKLSSKLFGVKILGGKAQKEAMELKMSPAARYGFTLFYGMQKEGEVLGSTGQEGLSKLMGQLVRTFLKKMWGSDTSAKGPQGQSLIQKAGNVSTVVGFMNELQNKRTAPDDSWILSQRLSYPCGDNRFVSRMKGYILPQKTSDCEAASISLIQTGKNLSSKISVGVSGVAALIFGILGVMSGGISMLFPALFIVGGLLLCLFTVITSLMDLGIVPTRQDGESAGQGDREPLQQEPYTSYEKEEDDDGKSSDYWGS

SEQ ID NO: 626 - protein, 795 aa, Neospora caninum
MDVHEHEAATGCRFSWNVWPATRAEAQKIELPLGCMFTPLRECTSLQLVEYEPIRCRVSGCILNPFCAIDFRSKQWTCPFSLQRNAFPNHYAMHISEQNLPAELLYPTIEYILPQPMPAANGAPGGAPAGGELPPPLFFLVVDTCIIEEELEQLRDSLMQALALMPSDAMVGIITYGAMAMLHELGGGSETVDVMKAHVFRGNKELTPMQIQQQLGLIGGGNNAYVPPRGGQGAAGSPLLRPAAARFIQPIGECEYKLTCILEELRRDSWPVPSDSRPMRCTGLALSVALSVLEAAWYQLPARILLFVGGACTSGPGQVVDLSLCESIRHHLDLQKDNKNARFVKKALKYYTQLANQAVKAGHAVDIFACSLDQVGLYEMKVMTEKTGGCVVMGDSFSINVFKDSLKKFFETDSTGFLKMGFNAKIEVLCSKEFKVCGAIGPCTGTGKKGCQVSDTVVGEGMTSEWQAAALDKETSIAFYFEVTNQQAQNLPPGKQSFLQFQTLYLHPSGRRRLRVTTLSYRFAEPNTIDVAPGFDQEAAAVLMTRLAVFKTESEESLDVLRWLDRKLIRLVARFADYQKDDPSSFHLSTEFSIYPQFMYHLRRSHFLQTFNASPDETAYYRSVLLRASVMNALVMIQPALLEYSFEQQGPPQPVLLDAQALKPNVILLLDSFFHVVVWHGELIHQWREQGFHNMPEYENLRQLLQAPLEDAKVILDERFPVPKYVQCNSGGSQARFLLAKVNPSTNYAQSASGGTPGMGGLMGDSAGGGESFINTDDVSLKVFMDHLIKLAVQS

SEQ ID NO: 627 - protein, 94 aa, Neospora caninum
MAPKKTIVKKTKAKKDPNAPKRPLSAFIFFSKDKREEIIRKNPELKSKLAEVGKMVGEAWGKLSDAQKKPYESKAVADKARYEREMIAYKKGGK

SEQ ID NO: 628 - protein, 98 aa, Neospora caninum
MAKDAAAGDEKKRRNGRKKKDPNAPRRALSAFMFFAKEKRTEIVAAHPELKSQMTKVGKMVGEAWGKLTPEERKPFEEKAAQDKARYLTEKQEFEQKH

SEQ ID NO: 629 - protein, 185 aa, Neospora caninum
MAEATVAGLNKYKLVFLGEQAVGKTSIITRFMYDTFDNNYQATIGIDFLSKTLYLEDRTVRLQLWDTAGQERFRSLIPSYIRDSSAAVVVYDITNRASFLNTTKWIEDVRAERGNDVIISLVGNKTDLADRRQVSYEEGRQKAQEHDIMFVETSAKAGYNIKNLFRKLSSPTVNVRHFAPMVRST

SEQ ID NO: 630 - protein, 2378 aa, Neospora caninum
MSSGLWKIFKRKGKDDDEAETKATKAHMGEENKMYYNEQLKRWVVRGEEHLVEQEQLPPPPPTSVGAAPPSAGPRGFARGRTSRSLYTATPGLNVRPATASASAAASLPKPAFVLPPFAASKPAVSSPPPSGETQSSSFPPPSASVEETAGQSPPLSNGFVKGAGEAETSRESAEAVSADLLKTADGAGASGELRPDEPVPKGEKPPEEHRPHPSLPVFSSSPVSACGGFADEAVSGGVVRSNISSGSENGLVNGIHPVGSPVPPRADADADWVAAPCPDTPFPPAASPPSRCEEQAEAPNGVPSMEARGRTEGVNLAGSHQGPSPSSAPALSAGPFGLSAAPATLSGPPRPASPQPAAMGQPPRPAQSLPRDLTASSAPSPSTGALGAGGSAPREDTPALHALGLPRGGLSVALDSSSEDEVETDSVTVGDESSDGSVSCRDFWHRAGGKHGTRLASRGIGGGDAADAESPRMLGRDLVRDRQQRSRGGQDREVREWERGRQPGFRESADSLQAPAYAAALKEWMDEPTYPGEDLGRMQETSRTRNGEGQPEELPSADAGVAGQGMAAQVHGHQDAVSVHQGGEVVQRSESPQEAETVPIASSLHATLPAERDGRQAGFEEAPRAIPRLDAQEAEAEGLVLHDPWSPGHFDARQGESEKLYSDSCEASSGVVPDPFSAPSVQASPSVGDARPGSHNFPVASHASVGSMARSVSPATLPVPVPESAAPQWGPVRGGALQADAPLGDCAFRVENSGPAGVTPPGSRPRVPNLRRVEGERWVEDRSPGSTHRTQVFHLADSEDAGVGALSGSPLGGRESCPGLGSPVETGEKRTGETQAAADTFPVLHGSSRIDESRQGVSGGEEDAARQQDLDAVDLFYQSDEAGGKHIQEQAVAQAQKEGFPEAYGEAQPNALSSFFVAAPFQTAGEETHRREGIIAAFSASVEDLERTSGAALEQLQEQRRARLELERRNALLQRQLHAVLVLLSRFSLSGQDRSRLARLLQPAASPKSELLLHATLNPSKHRETRDQGFEEGSDLGTPEVDDWTEEGRGGQKGGGEAEQGVGAWPNGTGEETDWLGTGKDALNDTRGHGAERSLSQHTLDDGHFSGEEDDVDFDADFVEADEVREAFNTLTQLLAGQLELQSSSRAELEVCQAEAEGYLLLVEEQQKHVIEPLCRHVERLQREQAEERSQATHLRLAQAELLRLYEGAAVVTEDLCMQMERAREEATAKGARMTGLETELQLEREKAEALRSELVARQRELESAAGDCAALRAQLESERRRWTTSQAEHAKRERELKEQRDEEIRVLLQEKEEAIRAGADQVALLHARQREKEEETLTREVETRQLREELHALQARLESVQAELASARESVRRAGEDAHRTAESLRLEVEARMQQECQRAVATLRDELAQLQAEREAARAAHASEKAQLVEAQQQAENAFTLFRHDAAKRDGAREEEIRQLREMVKTAEDAQSALHAEETKKLEQELDGAREETEKLRRETQELVGASEELRRQLEAARADQQHAAAAFEERLRRAVEGEKEAFSAERRRVEEAHAVALESLRTELTRDLQGQTAAQRSRAAELEQQLKEAERQLQRERAEKADAAKAWQEDLAQAKRRHEAREEEMKNKEAEIDVLNSVQDELQQQLAELREQCAELTSKRALEEEERRRQGEEEERRRQGEEERLRQELTNVKHQLVEEEQEKGRLTAELARLTGLFEQQGAEKKLLEDQTLALQAREREVGDLQRRLDGVSLEMERHRQEAQAQFERMLEERQCEWMRQKAVQAEEAARTAEESRRLLEAVQAQLDAKEAAHNALGQELEALRAALQEKENALASLPRKEDVESVTSRLAAQEESIALLRQQLEDKTQEFVAAEATWQAALEETESKGLACEARVREELEAAHATVVRQMEEEERRLRLVVDQEKKKAAAEEAEKLRQKFERLWDEESQKMLKAYEGVARRLEEVQYAMHAKDRELEEAKEREEDSRRQAAERAHGAEETTRELRQKLDERDAEIADLRKKANEEQSAKLAVLADQKRVCEEVGKKREALEKEVEELRGQVEEAKRRERERERQTEEAEASLRRTLQERDEEQREKDFRLQVLEERLEAERRKNASEENRRGEEIRKLEKALDAMKEAEQEKRRAEAATAELASRMEALEEEARRRQKRVEELAAELEETRRVPPTVEGVKKEALLVAKQNEELRMRTATLSTTSDFLSRRLQFFEDALDSLGPSGRAIVLEADRTVQPPEPVDTDTAAVADAALSPSLPALNLQRRGSFSAVASSSAVRVPRGGPGAESLDASTNAAVSGGHFAGPPFSLPLGNLQVSPLTVDGPGQMPAGARAPPKPPAFMQAFLPAGRGSTRAPAGTVQE

SEQ ID NO: 631 - protein, 691 aa, Neospora caninum
MRRPKSGCTAGSFVNGLAVHRLWLLVLFSALWFTPAILSPSRAAGPPRAFFPLHAQLSRIFFPAKRTNGASTGSSSSQQLVEMEPTQPESLPSEPLPPSTINARQRPERRQRLQSGSLTEASVSSENHGARLPAQVDVSPDTPDVPPGGSMQQDLPTVDPAAGLSPQTTHLGAPWHFLRNQMRSAARKARSVSQSVTISENRVNRHHRDSLETRSPTFHTEPETGRLTARRQRLMTSPPHIDSDDGPGKGTAAPNRIQSGTFLVCRLLTTDMSAGHAELQKRLGARTGGTRNRLQAEECEHAHGAHFALQLGDRRQKFSRAPIEFALDATFPRETDVQFKSDISRKIVTLRRGRVLGVGSRCIVVEVMRVETGDKWALKAFVVPRHQFPTHGTPPPWDTFNKEAFAIQQLKHTVPVVVYRNLRFLVPTDVLTLQGDKTEALRNRHEIGPAFFATYLLFPLAEGSLSDVIEVMFPETKASNAVVLRDNEAQALGARLTFSLQIVRLTALLHGQGVVHGDLQAKSFFLCQDGSLFLGGFRHLVRAGDPYQSPRPETVGTRCTPPEVLTPPKNAKFTFSLNAWGVGCILYQLWCGVLPFDLSPKPETTTRVILPHLLTPPYLLKKRFGKGSNSASPAKFLRFRGCVQNMPVEMHDLIGRMLQENPRSRLLPTQAVGDPVFKRVEEQSLVQEVQI

SEQ ID NO: 632 - protein, 2250 aa, Neospora caninum
MRPDKKRGTCAASGSSASHVLASPRGETSRLFASARSTPHISSTPYVVSPLNRPASALCAGNPKPPRGPLSEHRGCLLFSLASVASLLSLAASALPYEPAPRGAPAGTVSASPRGEASVEDALEEKYTPRNCKYRPLPMTLNDFAYLSYNGEITLGDVFGLPASSILHEQRVSFSIASEAETSANSRRAILSVSVEMHRDNVAEFNHLELYRRRKSEKPHPALSASEAAAAADGAGAMQSAIRRQQAVAVGRRVEGAGGPRTKVVLSAALSDEDGDAVFDLVRQETRLGRAGGKAEEVFSFRDSRGRTPLADGETIGHSPLLPCFPVRVDLSVVPVDRMPLHIPSNCPAESSLPKTAEVVTLGDAPLTLSNPPEAPFVFVFRNVSSWAPYSLPVWSTSVDVPRRLHRFARFFFRLSFRFVSGPLQLLLELFDEKSQPDPHATGPQCLLGCMGATPTYNGHLFDHAMPTGFLYKIWVLAGEPMFLEDHATQCMQFDLEYRVNYETRLTPFEVGHHSWMCKFARLPTAIHQIEEGERGENTAEAAADPVGAVYARSLDFKDWVGFPPDEVDEMMHFVDLHIKEPSDIAVSLYQANLRLRTALTSGNGDNLEEMCGEKVLGDKDSGMVALHCRVAPGTYHLALFAEYPLGGLPPCDGFYMRLTVKPLALLNQRYGCVNRASASTMQLPPLLISPSGPPPLSAPPPSEDVIDLGVVTEAREENFRTFVFRMTPPPVKANGAFKVVAQGRFTVEKSLSQVYVHLAVLSDFTAADLAGIIRREGGDEGESSATHALSFSHDYQHLVGPFDAGTYTVEIVALTPETLDFVAANSAQELCIPFVIDLRLVTRSGDDIHSGTWLCKNDTPHLPRYIRGEVDVEMTLDKEFLLPASGHQHLHLYIPRNSMLKVHVRSPHSSEPRISIFPKERPQDKLGEAYTDLFLETDVEGEYIVRIAFSLQSTSLPPCPTAQLHLVLVPKSAVPQCPWARGGGLSRDELKTRAEEHLRRTLDAGIFIPKQIAAHRLEVAAPRDFWLSPSVNPEFAFSSDSPATSVRVEVVLHPPWIPAQLLLFKRDSLGLRRKPEAVSLLTQNRLLLLATDVGSGDFVLRLKIYDEVDSPTERLCAHATIHAEIGDADETTVNALRAELLSLPDLMPVEPPLSSFNRRGWLSLPDVPVFSTSVFRFDEENPTTAVSSPAPRDLKRRPQFAARAEPEATGQDAIRLEKGASATLLTVEKPTLLRVASEPAVLSRDRLLMRVFCRKDAVAAAQTGETRQRAAVPGTVRKEEGKDDLVVGSVGGEDDDGLNFMLIEEADSNLLVLLNPGTYKFTYQAEGPFLITFEACVSASGISSVDQLHRDLLFHPASPGGVRDSESPCLANPPALSLPSPLPFFFESETFDVKLQPSFVQKQGEIMNVPLHVTTPSVLYVESGSNFLLDFIKVGVRVAEGTWIGEQRGRVNFLRLILEPGTHYLKIYNTHANNVYKPEHEIKQSVDSQRCLHFSLKIRVVAVNYAGPEGDADAADSCFSFGAMSLPLDLHSSEGGSAALGGPIDANGRLLIRSKIVLTDANGEGKKRVALDTKGKDLVLKLGVFSEDHDRSVVVQVEDAHSLPVAAVHDWTISDGGYEKLFELDGSKRKYNALDQSSTFYLTFRLDRAAVAGAAPCVVFDLIIQVMPMEDKHKMAECAASGGASVSPVSISQFFPRAAVAAAADRSSSFHSGRQQHVSTALTAVREPRDGFLAEIPFSLAEESFILAEVQYNFFLSHIELDVVEGGDHRHRSQESISFGELDFINKGNHPLNTRQWVATQLEPGNYVLRVADDHYGNHFPRSYMGEPCFPLKFQFQVFSLASPQTRPTVIGVHPDPSLPVKYGQDLVVLLRLSTPPSAAGESASSETIRRSAYLFGETGVTLYPTHFANLDSYDDAYEPEDAQSDAHSTGVVWSFLFAADKLQRLGNSAKFVLEFTSKRGGQPYTFGILRSGVHTPAGSTFSSSDGADYITEVKFTFLSPGTLRENAPWTGGLASFALQPAASLAPAPGRATPAVAQVSASAGTIHRESSAQKAEAPPPKSEVLRELDRASAPSTVSPPGARGPLIPPKVSRSELLVEDDEADEPTKPGRVAPWDRAPRVTEGTRRAKRKDPYATHDTSVSEWEKPDREDDLGCGPDMRWNEETAECEELDDDLDGPATLLLVFVSLIGVTGLLLLSRYVLRRRAKGAARHPYRLARANSAGSDSFDFLPGQNALGSPAGLSDRDDDV

SEQ ID NO: 633 - protein, 104 aa, Neospora caninum
MTDQNANPALKFQRSVEELTSQNPHNDDPRNMQFNQMNTCSLRYAMFARCAKELGDENTRCKYQFYRAQVACPIEQIELWEDYRQKGTCHFDLLPEFSTRHMWQ

SEQ ID NO: 634 - protein, 105 aa, Neospora caninum
MAANAASKFIPLLDRVLVQKIAVPTKTKSGLFLPDSAQKNISAHMAKVLAVGKGRPNMKTGEFIPPCVQVGQTVVVPEYGGMKVVIDEQEMQVFRSDDLIAIVQE

SEQ ID NO: 635 - protein, 243 aa, Neospora caninum
MVNLAAVSGAAFAVACFPAVVSARKAVGTAARHTSLVNEPVALAQLSSVLELVTVPCDAVHVQGTMGANDLVKITGAGWGSGALQFQVSHPVKTGGDKSRSQLASVTCYSSDATDAPEGKAGKCFLTKPAEDGSSDEPQETEVSLPITSHNNAFMFVCSASTAPGVQCDVYAFDNVANNGWSVKTLDLGLSTSTDLGFSVHAEALNTMKAYASSSLTVARHDISLGCKNTPVEEETTPQGEEA

SEQ ID NO: 636 - protein, 169 aa, Neospora caninum
MSSGDSVAPHQRAACEQLHGEYKQCLAKSGRTNFSACTDFHSKLRACENMLSTSYCIDEGINLMKCTKKPDSSFCAKEFVAMRECNRPRGPHIVLSPSSSPSSPPHYELRPEVKHLYNVESTDLGAAVAPMRNKQQLDGVADSLKAELNLPGYGHVPYKWESLRPNPGA

SEQ ID NO: 637 - protein, 256 aa, Neospora caninum
MACGIPWKLARRDELMEARQAERQGDYFPPPYPPCPPTVVMPLRTTAYDLPEATFVTRPCPRPRKATGHKNVFERLTDTAYYTGSHRERFDEFGNGRGIAGREYLYAYDGLTESPSRCHEVYSSVVKRPRKPVVTPGTLGVQRFGVQIPAPRLMWLYRNGDKHDDGTPFFVRPYIKTMESLYQQITKEITPIAGPVRRIFDQNFRVVTDLEDIVDGAKYLCTSGEPPAAYDRLEKFLSEWVIQKSQTKVPSQFFVV

SEQ ID NO: 638 - protein, 208 aa, Neospora caninum
MMSNLVRPIKLQEQHLRLIYDDFRLLDENRDGFIDQIQYATLVRALGQTVSDREIDRSWQIALEEQRKQNEEAKAAQEKKEAQAKKEAAPGTLGLPKKQPPPKPVAPPQNEVNFQVFTKVFAENYIPVISEKTLRQAFQLFDPKNTGKLSSQQLQDIVMNRGEPLSKAEFDELVLLAGLDGQKSFDYTQLVKRLLKGPAGIATINATR

SEQ ID NO: 639 - protein, 224 aa, Neospora caninum
MTAYGKVDYWDERYRRDVEPFDWFQRYAGLKPILLEAGLEPSSRILVLGCGTSRVSEEMYADGYKNIVNVDYSSVCISHMQRRCADKEEMTFLQMNALDMKDFQVGNFDLVFDKGTMDCVLCGDNSFDNVQKMLREVARVLAPGGVYIVVSYGQPNFRLSHLQREEYGWTVTMKTIQKPSINVQAPIDEKDNVHYVYICKKAAGEPAHPPAQMSPDATKGSPTN

SEQ ID NO: 640 - protein, 119 aa, Neospora caninum
MGVYPPVAGGPIYWALRNTFLGARRTSCRLMRAYDMNWDISKVVCNGVPRNSYNPSVNEWIWNVDTDLWNGAGGKAWFILSGQVMFTFFWSFSLYTLLERWYVNGKIDTFSKWQGRPTD

SEQ ID NO: 641 - protein, 221 aa, Neospora caninum
QLLLAESFKVPAGGSFSSITSTQSFVASGKYDGKPAFAAIQESVTAGPQMRRVASALSIRLPDGARTSNGRLSAESFTLGPLRASSAAGETAEDDEASNASTSQVVTRKDLVASVAAELQLSRADVERTVGALLRHIAASLEQGQKVSISKFGSFGLRRRGERVARNPRTGEPLNVPATTFPTFSFSKVLKDKVRDVMPAHEDDGDDDSEEPKKKGLFSWN

SEQ ID NO: 642 - protein, 225 aa, Neospora caninum
MSSWEDEADEILEAEERRKQEEQQRAAAVAARKAASDAKRGFADDADAPLSDPVAEKMRRQKLVEEADKRLMDDLFSGCERPADYMPPTATSAAVAARTKTTKAAAPVVDPVEAISLRSYKDCEQFATRLGKKIRESPAKSPAWLRLLDLLLKDCTPKMEMKDLVSLQKKLQAAVADREKESKQVVEKKKKPNDVGSAMKNYRDEVDMLYGDLSQDEDDDEEAFL

SEQ ID NO: 643 - protein, 194 aa, Neospora caninum
MASTKSSSSKAPGTDSETPSAHRHASHAVGGYNWDEFRHFLDSQGTLWHSAVLGAPASVAPNTIFELAPTTAEAGKAIAFRPRLDAYYDAASHKIVMLFDLPGFEKKDISVEVDDHAIIISGTRDRLKDKDLFGEKSRELIKERAFGHFCRKFQLPTNAVEESVSATMTGGVLEVTVETREQETSQTKKKIEIS

SEQ ID NO: 644 - protein, 288 aa, Neospora caninum
MTPGVAAGNGNAGGVRDLSKGAILQCVEAATLGMPFEVWKTRMGRYRKESTIEAFQQIYKQGGVQAYWRGLAPKLVESASKGAVLLYSKECILSSMRRLGASETLSGFAAGAGGGICQTAVMGPCTYVVTALVTGGRDKTHGGRASDKIREVWRTKGVKGFYSGGTAIALRQATNWASRQGFTEWVRTKMKGGDERAKLSKTQEVAAGIVGGTLSTWNQPFEVARIQMQAAANEGKQKHNILQVFRTIVVQEGVQGLFKGVIPRIGLGIWQTLFMVTGAKLLKDSMNW

SEQ ID NO: 645 - protein, 481 aa, Neospora caninum
MKMDKGGQAASADVKDAGKKAPPAMGSGYYSDHVDQNEQVRLLNRLANAEGSSQVKQDAVLANAPEWKTLEKAGVLPAGLSVVLSKISPLCLDEFSEMLAADPDLVRSLIGLVRLEGDLHTVQYVLTVLCEVVRDDSSKYEALCSAAADGEVFEAFRQLLEVPNLDAYTADRAAFLLSGLMCRARSGSFTDTQVEYLIQGLLHGRAANKFLLSEAGRLDAFVNLLKIDRYRPMIWASRGFPELVLKNLSLTLPASVLYKAMFCVWLLTFHDTFLPQLNEKGIVLAVCVVLKESRVEKVIRVGLGVLHNLLKCDASVETIIEQNVAQVLALLEFEKWRDGDMYDDIRIAASHLEQKTRQFNNFDRYCHELDKGKLTWSVIHSEKFWRENVMAFENDEFRAVKKLVKLLDTSTDKTTLAVACYDLGEFARLHPAGKKVCQQLKVKDRVMLMISDKDREVAGEALLCIQKLMLNNWQDVAELKK

SEQ ID NO: 646 - protein, 192 aa, Neospora caninum
MDPRVAQASVSPVTDRLAILTARCRGLVTGAGSMVCVLVVFLTFLGCFEASLVVGVDARIAKNDGLAVPSSRMEAVIRAQRISGTDDDTAGESSWGSIITARVPGEIRIVVPENSSKRSVSSDAASRIDTLAFSRHERPADLPTSFWDEDSVDNWGDADDDADDAADFMRPNRSLWSFFMPGFSGPGVRAKY

SEQ ID NO: 647 - protein, 725 aa, Neospora caninum
MDGPLGDDSKRLTDPLYLEMSGNIQQQLNMMKSISRCIAEGAITFLAQEFKYMAVYIVVFSTILGIFVGVRTSSSIRSQVLDPTTKQGPLSTMAAFVLGALTSILCGYVGMKIAVYSNVRTCHEAWMELGRGFQLALTAGSVMGFALVSLGCLTLVAIILLYRLPALFGTNPEDQKALFEAVAGYGLGGSSIALFARVGGGIYTKAADVGADLSGKNEYGMSEDDPRNPACIADNVGDNVGDVAGMGADLFGSLAEASCAGLVIAGASVATSAGGPQGLAYSWSGLMFPVLISSTGIFTGIVTVILVRACISVRCYDDIEKAFKWVMFISTGLEMPVLILLSYCFLPAEFLLDGCKGTTAWWHAAICVTLGLWAGLAIGYVTEYYTSHSYFPVREIAQTQIVSAATGIIYGLALGYSSTVIPIACLGVAVLVAHTLCGMYGIALAALGMLSTLTMGLMIDGYGPISDNAGGIAEMAGLGPEVRSRTDALDAAGNTTAAVGKGYAIGSAALVSLALFGAFTVRAGINTVDVLDPWTFTGLLFGAMMPYAFSAMTMKSVGIAANDMVQECLQQFPLIIQGNIEPQYKRCIEISTRASLHEMIAPGALVICAPVAAGMMFGKNCTAGLLAGALVSGIQLAISASTSGSAWDNSKKYIESGALGPDHAKGSQAHKNAVTGDTVGDPLKDTSGPSLNILIKLSAIISLVFGAFIAEHFSNAQGGPAWVHV

SEQ ID NO: 648 - protein, 366 aa, Neospora caninum
MARCKPEGGYENPAIGLWAVGCTMQIVSSLILFILASALTVTKDMAGAAAKPEVTLMETTVFMGLGAAELVTTLHLMVVVIMGYFVSKWFLVLSAFVGFLVEAAAIASSIICGIILTEVANKQAEALDYVRAGGTATPVPVLDYSGEFGTAYQGMIVAVGVLSLASLVPLSRAQSMTPNTRAMEAMVFVFGMTLCSLAACVFLLQSQAMASVRTLGILWLVASVVALTFVSMQKACLPRIMSILLAVVCVLISVYAIASAFVCAHEFLKQKKLSVTASGISPSQISKWIQSLSDDDYATLLRGYSTLDGVYFVIVSCISGATVIFILAGAMAALRSICGPSRAEKIMSRESAEEAIEAREEHTPNP

SEQ ID NO: 649 - protein, 324 aa, Neospora caninum
MRGYVPSPCSPLPVNDRKLVHIDCPLAELDTFFPPSAFSPNIAKFTGVFFETKAEIFQHVQKGGTLGPFIEGDWVDHQVDLSQLPSMVMLGDSNPDFFPVVPGRGRVFTSALKAGGFALPAHLLTKFKKKQLLPLVDDGYYQPSASRPPTHLDYKNTQVKNNALYSGDPDHPQIGDVRITFWGSTATHVSLIGLQTTGFLGSDRHIQGIPSPALQNRTLTIFAEGDYNPASLVAEHVSETHASNSQTWFLRGVSVLLVWFVLFLTVVTCTTPKTCCVVFVNCGLSSLSITAGLAGMVWWKFDIIVATSLWVVSSVAIVLAVLAW

SEQ ID NO: 650 - protein, 821 aa, Neospora caninum
MADAATAPGGSSGGGAAGEAQAPQQSFLGRIGNMMMQIMLFQAVMQLVSNFTGNRQGLAPPGAPTGPDGGAEPGGMPPTWAALPGNVVLHNYFPPSTSFDVYMHLTYITVPLPPQASDVAAPDAPTGVSSLLSSLSSSLKQFAPPTGAATTSGSRNSFPIRVPLSLLLDRASKTKRRKETAGEAKETAGEDNGPARNEDILIAVDRGLLFGLPREAGETELVRVSANVVEAWKVFNSTYTYDRWSSSPETNVTFTAPVDFLSQPVVPAPQPAGDTAVSGAEKQARGQEPKTGAEMKDAPREQTALCLITTIVPHWAYKAKGKLPEIWTAETVPEIEEAQTLQRVTSLMHAMPMVTNKDEEEHSLLLGGEVEERKKKDNEESEPVVWHMKSRMDVLLVFDSSQHSPQNLRVGPMQNIAVRPADAAYEPVVFHSDFWLLERNFVPLNATLAEHPLNLTLSFGVGSVHGWLVQEQLGAAFEHQQRMGLQSNREAMMFKRIIIETNPFMLAFSTAFILLHSVFSFFAFKNDMQFWYKNDSMEGLSALSLIFNFVCEVIIGLYLFDSGETSWLILFEICLGILLSAWKVTKAVKLSLRPAFPYIHLDFMKSYTESHTQEFDSIAIRWMSIILAPCVAGYAIYALLNNKYRSWFSYIISVLAGSVYTFGFITMTPQLYINYKLKSVDHLPWRALVYRSLNTFVDDVASFLIDMPWMHRLSCFRDDIIFICYLYQRWIYKVDTSRTPGAAPAAQPAELQQMHRDEDLQPSGSETNAEETAGGKEGNQGPTSPRESSSSFAGASRPSDNTTDAACKRINRTHEARTDAM

SEQ ID NO: 651 - protein, 407 aa, Neospora caninum
MNRDAGETQLPGVAAEVRPEGCVCHDTSLDSVLKIVGKDLGLDANDIEEVRARLLVNQITTAQALEAAVREQRLCGLFHPCVTDAIAARVSGRVLPMFDLDEFSETRLKVKNPAKFANGAVFVHRIAPVPGTRKGRIAVTWAFDLDVETTTVAELLQHLEVLVGDVPVDRMRLVFNGFTMSTTSSLRSYDVTPGDTLFLYTLRDPQAQVTFMCAPPAVPTHLVPAPLPVGILPTTVPAPRSSLPAPVTVLPSPVACAPVPGLSVSPVPATNPGEPYDSSFPRQTVPSVSAAPVGAFLAKPPSGGAHLLAPQIIAPQLAPAVLPSVGGAVLTPAVCQPVYGCVAPGAQLAVGAGGYGGDTCLVTQPVDRRVETCKCGSYTAFRYAPPVPPVTTCGTCPMELQSAGGRE

SEQ ID NO: 652 - protein, 225 aa, Neospora caninum
MAGQGKGEQATPAAPTPATEEIADTAATDSQQEEEQKRLELILSNMRRVSNLYSEAELLRVVEDYVADCMTHLGYQEYRLYSNLRLLIASFACCVAAYASFGVPFPTDGPYLKLSIVTFFVSLLVLLFIETVCVKNAIACFKDKDGEAFFIDSHIDRNTNDLVLAIRQKSLYLSTASNVGRFFDSKGYLLIDTLYEELTNLLQDFENGLSDATKLAAGRRKKKNA

SEQ ID NO: 653 - protein, 811 aa, Neospora caninum
MFLSVESHETEGRSASPTPASSRSPTNGPQTALSLWTLPASLSSYLSSFPSSLSRSPKASVSARRGTGEVAADRDGAKQGEIDEVNSHSRGVRFDLCRPGRNEDTAADGPVRGGTQRNAKEAMAPHSDGVQTGGTGTRDGGEVSPFDKKPGESYAAYADRLHRRDGFSLYFDNNSSTMTDPRVYQEMAPFFECLFGNPGSAHERGRINKTALEEARVRVARCLGVSPSTVIFTSGATESLNWAIKCGAHAQCRRGVGRHIVTTRVEHPAVLEICKFLQEDHGFGVSFCPVDCFGFVDLGALPSLLSAETALVSIPHANAEIGAIQPIEESLGKVPVNIPQLGADLVTIAGHKIYAPKGVGALYVGPRACIGPLLHGGGQEGRLRGGTENVPYCVALGKACELIAEGWAPPSGVVRADFLSGPAPPSPSSLPCAPAPLTPAASTSADGASPEAGSAPETQCVADQGVHTAPARGGGDLPGVGERRGEPSEVEIAGRKETREEGSCVEGGSGLGAERTSTTRLAEGHSGAPSGSGVRTPQAEKEGQKQSFSSWLPSLAAAFRQGGSSEEKHDNGSGVVSGFPATPSAFHRFCSSIGFSRVLSLPFGSRSAGGTIPGEWRSFWPERKDAGFRRVSAHPQHMQKTLIRFTHQFFIEVSLLTQWTKDQLADFIRINGPLGQAGRFFEVTDGQQGKSLSEMYGALPNTLSLSIRGAHGPEIVRLLRDRLCISAGCTCHSSGELTSATLQAIQLDRDWARGTIRISTGRFTTLNEATVAGRLLARFLISENLIFGKSERLAALSAGHEPGEKRGAEAS

SEQ ID NO: 654 - protein, 1207 aa, Neospora caninum
MQPCSVSTASATSSLPLPDERGDTERAENRPENEETDESGCLIGFPRKCSAKATWLFSTLIGLFFLFFLYRRHRLTFEWPYEKQQISAYSEGSFYYSFFNDVIAAPTWRAGLDAVLRDERSEHPDVVNALRRFNVYQELLAGLLYRALHALLGDAWLTEYIARTPFNFYTACVFLLQALGVAVLVGLAAVTGGSAFCACACFGFFFANYYHRLVVRVQATPLRENWALPFLWINIATVVVLLQTHARIQRVMLRRWATRKDSAKPSASAVPCRDAKCHAALRQREKKLLALLFLSTLLLLVLWQFGVFVITTQVAALFATLLVGFPVERLMRRVFAVLCAAFVANVFLHFFPRYLLLSFLPHTLFSVVFVLLAWPISRLRTARQKESSGGAGGAALRLFPQNVQRGFLAVVLCLLIRLSLGGFDKDDSHVFQLLLYKLGLAPHTFDTNIYLMGGTEFEFFSPYFFNLIAPSRLFLCAGVALFLFLLLASDQLLFLHHLGRLSPRLYVNLSEETLTVDGGEEKMEEDNEETARQKAVETSDPPRTTDSRYQHTRRFPSSAGAPELRRRRPGKMDKQDEAPRSAVDAVVSVAEKRRRVEGKLRAQLEDQLVSSVYLMPDLFYLSVQTVFFVVLMLLIARLRVLCLPLLCVLAAVTVASPALWRALACALAASLNLPTVASLGSRLTGGLRCRSRVAFLVHALLFTCAAALPFCLKLPVEEMIGVDPATENAANPSRLSLIDWLKTNLPPDAAIIGDMPASATLRAATKLRLVIHPQFEQTEMRKRVQFLYGASACPPEKLYAAMMQRVYKTDYLLISNFRCAGGPKRCRRFLHTDHLACLCHSLRRSGSASAAPKEKKISVFSVADLVEEKSFTCPKAVASLARFCFKSQLSSSAFDLVYRNGMYAVLKVKGAQEAEQPKKKGQRDAAEEAGGERTAQRDRREEERELKETLRSLDVQTKNEAYLSFDWKTKLSTLETFDPWIKRCIRDDERCGRSMQEFAQELADMYGLQLTSRLLQEKAISLFPSDSDVLFGHGVFLDFDMNNRNDATAYYERGADKDPLSVAKTVQFLLFLDQAIGRSRAVADVDRLLRLERVLEEKTNQQLLDDAASLCKAALLLKQLVDTQVEAGAMRDTPNVIREEMRVMRRLWEKSKELNIQNECVVEAWAYFEKTRLTLARRIQHFFLGESVFLSRLVHALALAARVLSLF

SEQ ID NO: 655 - protein, 475 aa, Neospora caninum
MATLGRLLSSVLLLALVALSSLSFTQRANPSSLSSSLSSSLSSSLSSLPALSSFSLSLVSGAAAATAADPASNTPAEEEDDDEDEFIYQDTPETPTISAGDSRGAQTEGQGKAEKPSPSHPSRVPKEKSYIPEVIFACVLILAVAVAFWGKNKNVQVADAWIGSVAPLLKENFAVVGYENSYLVMKAYNVFELYCTGRRNCFYLHGVLQCLPRQCLWRYFFLQPLFRSQAEDSANSVTLEVLLPPSSEPSVVAVCKRTEQKNLMSNNWDLREFAKARNANSNPKLGQLAANLQAFSDTSEALDAVVLGNKTILKTISSCAEHFRYLYFSDVCSSLHPSTLATAASCAAAAAPGSSANSRNRRILRLSFFLPPVDRMAEVEPLLRLALYVADQSRHLGLSDKSVEVAKKMRLQYQKEMLKEQEEQRLEQLEKRRSERKRQDEEKFEKMTPEQQRKYEEKEYKKSLKQRGRFKVLKM

SEQ ID NO: 656 - protein, 74 aa, Neospora caninum
MMWRSSGVSFTRYASEMAALLRQCLKEPYRTQAMQRNQIHLKETVYQQGQVLTRETFNDIKKAFEAAAKQGGEK

SEQ ID NO: 657 - protein, 75 aa, Neospora caninum
MAHYGLLFARGWFSKSLGATVFGLIGMHQLAKKYYDIPTYRDFNLTNWSYALERENLRRQGIDPDSVDLTGEGSA

SEQ ID NO: 658 - protein, 134 aa, Neospora caninum
MLNFIPKRCPSVSLLFGKRPVQRIEVGQARHQLEIPVETIEKIYEGVDSRLEYHNKDYNAMKWKDFMKLKLDAFYLLEASQSEAAAKSALSDLNWFPDLADIYSGQQTMAAMDVALKAQGQQKLSYPIQGKNIK

SEQ ID NO: 659 - protein, 125 aa, Neospora caninum
MEEQIQRGHCKWFDSKKGFGFITAEDGTDLFVHQTEIKAQGFRNLAEGESVEFRVQVGHDGKRKAVGVTGPNGGFVQGEPRRMDAGRGGYRGDGNQGPRYGGNAGGYNGGYNNGYGNPAPGGYGY

SEQ ID NO: 660 - protein, 237 aa, Neospora caninum
MARIFSFVFFFSCLSCVFLAVELTHTAALRVAPKPQLLFSDEGPVSDSASQFDAELQAKATQAAAEAEASETDDIPSDRNTPPTNSDPTDQRDVQTDAVDIDGFPSPVAPLSVDLEAERLQEEEFNKEEEAPNDVPSLLVGPPQTPEPVSIPATSLLPAVPGAVTAVSPQNPLGAPEESPATPRVPPVQSSPARRGTFARLPRTRTITVNVRHYFPQGVPIMVIRRRRRPSFLMRRF

SEQ ID NO: 661 - protein, 193 aa, Neospora caninum
MANNRTLARRRRAFSPLTVVMLAVTLVAFMGVPLSSTGAADAADPVESVEANRRGYTSYGEPPVAVGTSEEYVNSSELAGSRDKGNAEAEEEAAEVETDVQPSSVTIDTEERAAPSQVQVQQERMEEADDAPKPVPVRSAVPSTVAKRQQARHRVIGTAVIAAVVAALLWKFSRRRSGAPREGGENENGGEEK

SEQ ID NO: 662 - protein, 94 aa, Neospora caninum
MDTMSDDKKDDAGEKEHMQLKVRSPDGSEVYFKIKKKTKLEKLMQAYCNRLGQHMDAVRFLFDGERVKPEKTPLDMGIEDGDVIDAMVQQTGGA

SEQ ID NO: 663 - protein, 68 aa, Neospora caninum
MEQPKLAKVEKVLGRTGSRGGVIQVRVTFMADETDLAGRSLIRNVKGPVREGDILALLETEREARRLR

SEQ ID NO: 664 - protein, 112 aa, Neospora caninum
MASLLQSLHRLTYWLVGGTDTQPPAVPVPSKFQPLLGEVLVFLNLRGNVPSNWSREQIMSYVDNSITDSELQAHAINFLKETGRYTVDTKLAATKTTSTDAGAGLGEFEGGK

SEQ ID NO: 665 - protein, 91 aa, Neospora caninum
MDSDIPADKMQEMETQLAMLLEGQRQTMKLLDRCFSRCIDVPGNSLTSTQQQCVSNCTKTYWQASMFCTERLRGLAEKELQAQGGASGFSQ

SEQ ID NO: 666 - protein, 170 aa, Neospora caninum
MQRGAMRGVSPTARRRIVDRPGLTEDEIEEIREAFNLFDTDGSGMIDPKELKAAMQSLGFETKNPTIYQMIADLDRDSGGPIDFEEFLDAITAKLGDKESREGIQKIFSLFDDDRTGTITLKNLKRVAKELGETMSEDELREMLERADSNGDGEISFEDFYAIMTKKTFP

SEQ ID NO: 667 - protein, 263 aa, Neospora caninum
MANHFDFGGPVSGCTGSVNFLAQVDTSAIDEMDPSLADGHVLVYSREVPFEIRLQETAAGLPGDVGRLEPIRVKILILGEETNPQHVRVELTSENDLFLNYTHALNEDLFRQMQERQKLMIEFADYPSVLIKMLNSCIKEPHCFLAVLVMQTTGKARVDFIQSMEYKFIELLCLDCVQSTEEFTRRDMTFRYNALKSKLALLQARLHDIGCLLKLKSPSLLLHLQKAAHQQANRRQHEVTAAASVPGKARVPGAADGASARFL

SEQ ID NO: 668 - protein, 263 aa, Neospora caninum
MRGGFRGGGGRGGSGGGRGGGRGGPQKVLVVPHRFEGIFMSKGKADSLVTRNMVPGESVYGEKRLEVAEESGEKIEYRVWNPFRSKLGATIVGGVANMPIKPGSKVLYLGAANGTTVSHVSDIVGPEGVVYAVEFSHRSGRDLTNMAKKRQNIVPIVEDARQPLKYRMLVGMVDVIFADVAQPDQSRIVALNAHHFLKAGGWFVISIKANCVDSTAKPEAVFAAEVDKLRKEKCKPKEQLTLEPYHRDHAVVIGQYRVSKKKV

SEQ ID NO: 669 - protein, 177 aa, Neospora caninum
MGAVSSCCAVEESEDRQVMQKEQVAKTSKGERSRDEKKKGEKVGKKSPSHRSGSASAAPQVTAADIEELNQRLLSGMAVLVLLQDGTRLQCILHYNETDNSLSISCEDKVRVIPLSDVKALLHTRDQLQRVETKANLTDDDSCVALHLLESGNCIPLRFDSVREKTCFVELLKKLKA

SEQ ID NO: 670 - protein, 232 aa, Neospora caninum
MQQPQTKNGGKQLPGGSVVHHRGGSHLPISALVNFLFGLLLSVIVVVTAAGIAHLSLPSNHPLQEYIGFVLDHAPRLGLSRALEVTPFLAQAADALREAGHLRVAEYLDRAVAWPHTECAFLTGFAAIALLLAMTVVRGLWLYKKEREIEVSPPQHMYCSNTMTPEQFADRRFTYQALAQLMKDPEFLKLKAQRAVQGSEAWNWQKRKAEQHEEDEDESEDMASEGEEDENN

SEQ ID NO: 671 - protein, 276 aa, Neospora caninum
MEEDELSQCRALYYVGLYDLCIARCGATHVTGTLAQQEKEGMLYACRLMQSRQMQGNVNPNEIRAMSASPNPFLRSLAVYTQFLAATSSQEQLTLYHQLRALMQEQANTFSVFFAASAAAALGNFSDALQFASQLQLLEMRVLKLQILLLMNRGDLAEEEARQVAAQNDDAPLSKLATALVDTRKAAANIQRRDWNSAFEDALKAYQQAPQDSDTLVNLICCCRNMKRHQDADFYVERLSSVAPSHPMVAKMRELHAAFANAGVPQTASPRTAVPL

SEQ ID NO: 672 - protein, 539 aa, Neospora caninum
MSPMNIATDEFGNPFIILREQEEKKRLKGIEAHKSNILAACAVADTLRSSLGPKGMDKIIVGPDGQVTVTNDGATILNKMQVEHQCARLLVELSQSQDAEIGDGTTGVVILAGNLLTQAYRLIEKGLHPLRIADGFEKASQLAVERLRQIVMEKDVYGADKELLVHAAMTALGSKVVSSHQRHLAEICVQAVLTVADRERNDVNFDLIKVDGKAGGLLEQTMLVNGVVLHKDLSHSQMPSVTKNAKIAILTCPFEPPKPKTKHKLDIKTVEDYKKLQAAEQKYFTDMIQKVKDAGANFVICQWGFDDEANHLLLHENIPAVRWVGGVELELIALATQGRIVPRWEELTEAKLGHAGVVREIASGTMGDKMIVIEECKNSKAVTVVVYGGNQMVVAEAERSMHDALCVVRNLIRDPRVVGGGGSAELAAAIAVENAADKIPGVEQYAVRAFADALTGVVEALAENCGLSAIEEVQRVKVRQRTENYPYFGLDCMQKGTDDMLGQNVLETFSSKSNQIMLATQVVKMILKIDDVIAPNDYQ

SEQ ID NO: 673 - protein, 222 aa, Neospora caninum
MAPSLESQWPSSSLSSSFFLPTSRCSGRRRSVSASQKGEKEGALRVSSARQKVTSLLVLFRNCVFSLLLVSLLCCFAEGAKPKDGRPVTYGSAVSLVHVLSGFKLFSGKISWGSGSGQQAVTAIPSADKAAAANMLWIVSAPSSGFRRKPLDSPVLVAETAGLQGTSSQLVPALVTPGAAGEPVRCGSVILLEHGSSRGTLQATGASSPISSQKEVDHTPEK

SEQ ID NO: 674 - protein, 130 aa, Neospora caninum
MASLVQPARFLDAAVMGLFAMVLSALMLYMFGEFWNLSQDPRFSQWKIGFFMQKLFPFKRNFDFNLTHILLFTVCVLLLSFRPDYEFLPADQQAQYRNGHTCCAQNSASSQQPQQQAEAGSAGKDGKKKH

SEQ ID NO: 675 - protein, 195 aa, Neospora caninum
MGLPDCCGKSKRGNAKCGDKVGPPATNPEAIGCATTAENRARESGGYLVFDPVSNGTLFLIWSNREVANAMAFFYPKKPVPDFKFKNGGRQEIFRNLLSDKKNYYEGWCHFFKAAAEFNGECRLLAGADTAPLRVTVAFLFGTTVKKLAQAQPLPTSGVVAIGCVPQAQTTFDVRTMHRDLFLGNSRQSGAAIAL

SEQ ID NO: 676 - protein, 391 aa, Neospora caninum
MALPDLYCLAYAPIQSTCLDSIGDDDCSPEVIVKELRMLQEFTSCGFRAFSKYFESDDAREKTAQASAALYCLTGFCNRIQSLSLAASNLAGGTMQRGYPDSSSVLRELVAAAKDVGLTPTDNEISNLVDCEKDAEWETPTAGRGKVEFRSSVSMIVNEPDRDDTPVVSHQPIKPDFSRKKVRKATGYAKFNFEKEKDDDERNDVSTSASPVPKSNKSTPDNFEKRESQMSEKSSGQQAQGSRMSFLCGLCSNVTDEPEVHVLRRESSVSMGVVQEIDDPEGDSHWHDRDRHSGRFNRIRKRVPTGHASLMKRSSDDLLELLEQDDTEEGKAAREILIRNTALNTFVPPGFAVSDEEDEGMSEASKYNGGVGTGETKCADAEEPRVLVDDF

SEQ ID NO: 677 - protein, 309 aa, Neospora caninum
MGVTSARQSAAAKALFKEASEVVGRDLLKLCEEGPEADLHQTEWAQPALLTASMAAVARWKEEQEASASPAPSPSATLGLSLGEYSSLCFAGALSFPEAVHLTRQRGLLMQKAGEGTGGMAAVLGLTREQSARLRDAVQATLRGRSGDSARTGEVCEIANYLCPGNIVFSGTRAGIDALEELATQKADPAEAARGFPRAKRVVRLRVSGAFHSCLMQEAAEGLRQALENAEIKTPKIPVVMNVDARTHADPRVIKQQLMRQLTNPVLMDKSLELLVDRGMQEGFEFGPGGVLAGLMKKTRQEVKVHQVD

SEQ ID NO: 678 - protein, 499 aa, Neospora caninum
LRIQSPKHLIEELKGAGAFEEQAGETIIGSTASFGTPAYGTVLRGKAFYVPDPATERVDSGSHCTPAYCEKIKNDVDQWKKSEATGGPSKVIFFLDRGICTFAAKVRIAQSCGADAAVVVDRGVSGWSRSYIRFNVIMSDDGTGQDITIPSVLISRTDGQLILDAVLGGGAVEPVLVEMEWNIPNRWPVAVDFWTDPGERQSSAFLQQIAPHMLDLGPHVRFKTLYSIFEVEGGSGEMCLTKGIYKQFPQAYCAFDPAAQSLAHTGSEVVEEALREACLYQTTATSSKDLPDSEFSKEFWQYHKLMADPQKGCFFNAEGRNEWSETCSMRLMSEILSSGQMKILKECIEGPQGRQLLDVSKSNRTWGPIALRINGARFSGNLDVETAMRVICASTKDPSTDRYRAPECDRLMIEVHKEEAPWLRDAPDWQNFFLVLLFLGIIAACAVALYYRIAKQRLLQEVRQEVSAEIQQQIQQYYEMNEERAPPARSGLERQPLVP

SEQ ID NO: 679 - protein, 307 aa, Neospora caninum
MANFEGFSRGDSALCGCLLFCLLAYMAFCAVLALRSLKRIKPYTNWEVLTEEERKKFAGYERNDRHRLSYVRTGLGGFFLLPWRMIVAFSLLISNGVTGWLLFRFLGAGGDTAPARERLVRKLIGYVAHLHCRFLFCVMGVYRIQEVYLGSRQDPTKRPIDQPRILVSNHVSCLDIPYFIRACCAAFVAKPVVLVYRSSYIDLGFDMLPSFDWMVLTLSSPGLSTLDVYWLEPIDPPPAEKFQTDEERANAFADIVRNRMWEELKKRNPLTPQIAGPCPTWWIGSVSVRREIVQTLMERQGLCWKTE

SEQ ID NO: 680 - protein, 164 aa, Neospora caninum
MPLPEPPEQMPLPEPPESIAQRLRRIQQKARELKKENKTLHERLNSRGSALEQETKNSHDSVDAFAGMQREILAEYEQLLREQQAEIRALQEQLSKMDSNVSSNQGNSTPAVDDSSYCSQPSLLCRWLACVYGSGNDDARSELKNTHGVLRTTVLPAETTPPGL

SEQ ID NO: 681 - protein, 648 aa, Neospora caninum
MSFGFCLRRCGVGRTLLGVSPFPCRGFLERKARDTRLFLTALLFTVSTVATFSACLATQRSAVLSQVYPVRLSIPPGSGQRSASFVPSPTPPFFLRASLQDSPGVRTPQPHNTVHSRRLQSLASDTAPHLAGGGVSPLSATAGPSGSNEPFDVTIIGLGVGGHAAALHAAALGLKTAVVSGGDPGGTCVNRGCVPSKALLAAARRVKMLRNKHHLAAMGLEIEGGRVTVDPVGVGSHAKGVVDKVRSGLIGSLASHGIALFDARGVLNGEPGRVVLERTAGSPASLPSSILTKNIILAPGSLPFVPPGVTFDEAQHQVMTSDTCVTLPWLPSEVCIVGSGYIGLEFMDVFTSLGSEVVMVEAGPRLLPGVDKEIAKLAERLLLQQFKERPVKLYTNTLASQVRPLGPKGEAPVEVELTDAKTKERKGKIYPDACLIATGRKPNTQGLGLDSLGVTLKRGGFIPVDACMRVLKHAPEGDEKPEVIQGVYCVGDANGQMMLAHAASAQAIAAVETIAGRPRTVNVKHIPAACFTSPEIAFIGDTEEAAVELGAREGFEVGKSVSHFRANTKAIAEGEGDGILKVLYRKDTGKILGCHMIGIHASDLIQECATAITNGISVKDLAFTVHTHPTLSEVVDAAWKKAAGMNAH

SEQ ID NO: 682 - protein, 293 aa, Neospora caninum
MKGLAASGFPGGGSGAVPGAYGSNGGAFGPSSSFGSSLVSSSALGSVMNSIRKVEVTRELVCKGTVSASVGIALGIIASLIVNCTLVEISMSSFFSFYFGLLFVTVGSVILWRIQVTSKMAADISVGGGEGDQPRKMQLQFFAALIIVSGILCFVLKKNWFVGLHPVVKVPLYTLLGISVAFALTFSLVDMVNYLLGFFQSAVAKPLVESKEQVNLVLFIALLMGGLFGFIFGVLDVEDEVQYHVRLALLREQHLCYPIGAILGGLAGLGNEILRQADEAKIRKLATEFDEEI

SEQ ID NO: 683 - protein, 300 aa, Neospora caninum
MAGTSYDASIGLLSDASFLSTLVASFFVIICSELGDKTFMITGLLAMKEGNALYVFFGSIAALWLMTGLSAVGGVLLPAILSREITHWLMIGMLAVFGVKMLLEGFSAEIGDTGEELSRLEKELALKKDAPTEMTTQGRPSKQAESAAPTQSDGDGLQTRHAPTATADDDATPLKAAPSAGRELSRAGPEEAGSCSVFCKSGRMLYAAAASFLSPVFLQSFGLTFVAEWGDRSQISTFALAADRSVVGVFLGAALGHALCTALAVLGGKVLASRISERIVLLTGGVMFILFAIFGAVLDL

SEQ ID NO: 684 - protein, 183 aa, Neospora caninum
MGLSVSRLWSRLFGKREMRILMVGLDAAGKTTILYKLKLGEVVTTIPTIGFNVETVEYKNISFTVWDVGGQDKIRPLWRHYFSNTHGLIFVIDSNDRDRIEDAREELHRMLNEDELRDAVLLIFANKQDLPNAMTAAEVTDKLHLHSIRHRNWFIQSTCATTGDGLYEGLDWLSRTLAQKNID

SEQ ID NO: 685 - protein, 131 aa, Neospora caninum
MSAENDGDVSSKAYPLASLEVTNQILDIVQQACSYKQLRKGANEATKTLNRGTAEIVILAADAEPLEILLHLPLLCEDKNVPYVFVRSKVALGRACGVSRPVISCSITNKEGSALNPQIAELKNIIEMMLI

SEQ ID NO: 686 - protein, 192 aa, Neospora caninum
MFVFNWFWDLLNYLGLSQKSARILFLGLDNAGKTTLLHMLKDDRVAQHVPTLHPHSEELIVGKIRFKTFDLGGHETARRIWKDYFAAVDAIVFMVDATDRGRFQEAKEELSHLLETQELAMVPFLVLGNKIDKPQAASEEELRQQLGLYSHVTFGKDRKPVPGVRPVEIFMCTVIKRMGYADGFRWLSQFLN

SEQ ID NO: 687 - protein, 334 aa, Neospora caninum
MTHLAPLSRSLFLPAYTSFPSRGPAGQDPDAQRPSGVHTAPASPPSALGRRRTSLEAEDRQRKLEGDGSSASALRREGDDRICAGDERGSPGRGGAVEIPRLLYGTAWKKEHTERLIKHALLAGFTGVDTACQPKHYDEPGVGRGIQAFLRERNLSRSSLFIQTKFTPLEGQDRTKPLPYNPHASVHEQVQQSLQTSLANLKVDYLDSVLLHSPLRTLEKTLEAWRSLEEAVDEGVVRLLGIRKFCQEHSVVYEAFWTLTANPHMLRSTPVREAARSFNCTPAQAWFRYLLEKGLVVLTGTTSETHMREDLDVLNLDFSQAAFDAVDSEVERFT

SEQ ID NO: 688 - protein, 402 aa, Neospora caninum
MATGSAQAGEHLQRQLEEAQTALAAVRQHQAGKVDLKEAWKAIQKVKVFVTLNPLGNIADPSLLKAVALIGRECFELAALLSVAEMQEQLHRLEGGAAGMVDEPLEGEEDFERHMLMLLPYYTDYADLVPPSQHHGELLCLYLLYFLACNRIGEFHMALQLLAPQVHSDPLVAEVLALEQHLIEGSYGFISDLQRAQRQDASGSRMKLGTSLPSAHVFIEKLVKTVRLKAAASLERSHDWVDIQYALQTLNLKNVQELQAFVEVHNLGKRREKAMPDFLGGGMNGNASAPAQSALYHAQGGVGAAGSVSTLAAGVGSGSFAAAVSFCASGEVEVEWAIEGNLLKFRKSGGEKIQTPQHCSTQALNVIGNLIALFAEPSSSMRYVMPSCFWYAEYATELERIV

SEQ ID NO: 689 - protein, 412 aa, Neospora caninum
MAAFASLSAASAAARTSGLSSAKGVGFVRFFSIFAPSRAAAVSGLQLSRPTAVAALSQFQQKRNVGGSALDFTVACRTSTETRKDLGPTTPMNVFTAVNSALHTALETDPTACLFGEDVAFGGVFRCSVDLREKFGQHRVFNTPLSEQGIAGFGIGMAAVGYTAIGEIQFGDYILPAFDQIANEAAKFRYRSGGNWNCGKLTIRSTWGAVGHGGLYHSQSPEAYFAHASGLKIVVPRGPYQTKGLLLSSIRDDNPVVFFEPKILYRAAVDEVPTGDYELPLSHAEVVKEGSHITAIAWGTQVHRLLKAAQEVEKEGISVEVVDLQTILPWDVDTIVKSVKKTTRCLITHEAPLTMGFGAELAATIQEKCFFSLEAPIKRVTGYDTPFPLAFEPFYLPDEHKVAEALRELKQA

SEQ ID NO: 690 - protein, 762 aa, Neospora caninum
MERQQDNGFPGFLSPKQSYSSLPSTAGQGVPAERLQSDIRSPGFPPATAYPAFPRSPAANGSHGASTVFYGLGNLSNMSNFIGSTNQLRSTAYSLLDSGRSASSGESDPFFSSSGTGGGHPNNSLLFSAAGSSCLSSPQRLGVYSSVRPQCPPPPVATSQKNSPVASTAPTPSPLTQSQKQPSSPPSSPALANEYPGLTQPNMYGRSLGDPFHQENAPRQEHTSQPQLGQHPRAASPLATPLRPHATSAHHPDHYVRSSCLPGSDCQEVDAEPYGEGQAERLWNFSSRGSLSFDDLIAQVQKLLQSNSTSSSASSASTPRRPSGRLGETVDMPWENKPMDNRSIWARRPMLGRPPIQQQGIQEGRENVERGDEEYSGCCVGQLDLHALQGAATQSVQPYRPVGDSSSPREPVNEGVNQNSASYIDPQALAVLQELHRTAVQQRMWEANLAVLRQENADLQNRITLMEETQSFLKQQNQSLRAAQHSAEASSHGAAKSILGVGRPATNKSATNRLIAPSGYQGPDQIQSAPNPSTPIIKGSDKISVEQFLLSFPFTLTQDYPHAILKFCADHNLVVKLLGYHGKRVELLERQYCCRIQTSAQASSFPGYPNGRCVLFTGPLVSLLRACADLYAVVDTSSPGLRTNIEGYRVCLVVPGDFVGRLLRSNCAGLHALQEAGGKAVHIALGNLCVIMRGNYSERVLLIDGNIEGVCQVLESAAAQLQDFLRRFSGGQGGAGGGGSEHLATRYEFLEYPKRIELHLST

SEQ ID NO: 691 - protein, 467 aa, Neospora caninum
MENSTSRAPRLSSRRPARSFCGRVAGICSFLLLCFASSTLGSPALRTSGGVNEVAAVGGDFCVNGLRAAINAAILELAGEHYVGSTLLPQFPDVPYVPILVCPAPTARDSLPPVVNPPHPKTTVVNDQGVPIKDAQQTRAPPTAEALARDRASLWPELSALHESDLLFDVLKSGVLKVAGLGPRGPDLRTNPDFEGLVADPELAASQAEHGFNWGQEGNYSVDPPVGYFPTYLRAIVEKVSMRYRKPVRSQYIFFSNGGDAMKSVARGVAHMTDIYFILAFQQGSMSHLDEFYHTCPVSASPNNLLTLKEYRIRSLQDLVRTLRMASDPAMRTLAYLSTGNYETVHFFFPRHTLGEVMAKEEAERRIAAREILGNIRTGTSGQVPDTFEMVDLGLVLAQGPWLKRTDTAHCVYHQLVFHQGAKKAYAPPSEEADAETINVEASTASGLRSQAGAIFAASLLASLAVV

SEQ ID NO: 692 - protein, 267 aa, Neospora caninum
MASLPSPLDLQAMAATQENTLTGLAPRDTTVPIVTTSSVLGITYKDGILMVADTLASYGRMTRFKDTSRFFTLGTHTAVASTGDYSDHQMLERTLSRYALKDFLHDDNSVRTAHQYGALLSRLMYQKRSRMNPWWLSVIVGGYQGERTETREVSDKCAKPFVLGYVDMYGTFYEEDVIATGLGRYFAITLMRNRHRPDMSEDEARQLLEECMRLLFYRDCGASNRIQFTKITTSGVTVEEPYVIDSKWDYEHYVKKTMDMGLAGCAW

SEQ ID NO: 693 - protein, 571 aa, Neospora caninum
MASRRSAVRRLGFLISLCTLLVAFSGCEDIEGTKGNGGDGSASNGQSLASHKKSRGSKKAPGAPEEGSLSHAEQGAGATSGVVNGGRPSVGVGNSAGQDSRTKRHGREKNARKGGKGRRSHEEKGGLKAGAGLDTSAADRAKDARNAGAAKLLAEAGEGASKASRPRAGDKETSSGEETTSSEQSDDGKNARRKSSGRGTGAPRTAGGTAASGPSRDGASREASEKHPAPADQQQVAPVRVNAKGSKPFTEQKAKKMVLVVDWYTKTIAATMNGRRPQDEDAMVVHAPLKNFPDARLKAIFDGHGGYQVSRRCVNVASSYLGSMPNLSEESFRETCLQMDADMRADNLKGGSTGLMITIEKVDDPTAPDGISFNVYAANVGDSRGLIVHQDGTYTIMSKDHKPTAEIERERIQRAGGFLLRRMGVWRALKDRDDLHPNEQKIVAVPDLNVFRALPGDIVLMGCDGIFERPEMNWQFVADLLSVEMEKTGGGLAEVAYRILETAFMLGSRDNVSIMITKLVKRPVKNTEVKRFDYSFTGERVVLRSEVLTHKPTDDKSGRYGTGKDMLVTLF

SEQ ID NO: 694 - protein, 311 aa, Neospora caninum
MSNTDDDLPRILFLHGMDGGPAGSKQRLLQRAVGRSNFLAPDLKSRKILLLYTIAFGCFIVLAISIIVVFWIFITSIHAAMFTIAAVIATCVGYYVSGRWLSSLILSTAVREASEAFHTYRPHVVVASAFGAVVAFHMDVPKMPLLLFTPAQDMYRRYLRTTQQMSLRNYPYTLIVHGSRDTVVSLQDSIRLVETAELGRCRLEVIDDDHHLRSLTQQEISAWVDEVFKRGRANVLMLAQEGDKSVDPTLYETPNLEAGDQRGEDKTRTEAADKEREVVTAASEGDDGRDGTGPVTGPLLSSSSEADSLLA

SEQ ID NO: 695 - protein, 419 aa, Neospora caninum
MSGFQRIKVEHPVVEMDGDEMARVIWAMIKEKLILPYLDIPLMYYDLSIEHRDKTDDQVTVDAALAIKRHGVGVKCATITPDEQRVKEFNLKKMWKSPNATIRNTLDGTIFRAPIIIKNVPRLVPSWTKPIIIGRHAHADQYKALDFTVDKPGRFVMSFVPADKSEPEVHEVYEFKGGGVGLGMYNTDASITGFAHACFQYSLDQKMPLYLSTKNTVLKKYDGRFKDIFQAIYEKEYKQKFEEAGLWYEHRLIDDMVAQAIKSSGGFVWACKNYDGDVQSDVVAQGYGSLGLMTSVLVCPDGKTIEAEAAHGTVTRHYRQYQKGIKTSTNPIASIYAWTRGLSHRAKLDNNQKLKEFAQALEEACVETVEAGFMTKDLALAIKGDSLTEQDYLCTDEFMEKLAHMAERKLVERQIITKA

SEQ ID NO: 696 - protein, 733 aa, Neospora caninum
MAAAGFPDANKSLTYFPARRDETVVETHFGETVADPYRWLEDPDSAETKAFVEAQNKLSRPLYRTAIREKFFKKLEQVYDYPKYGVPFREGDMWYNWYNTGLQNQNVLYARKSLHDEQARVVLDPNVWTEDGTAAVGATAFTDDGSLMAYTRSDKGSDWMRIFVVRVEDGYVFPDVVKHVKFSSLEWSPDNQGFFYNRYDVPDEDQEDSGTANAQHEFQKVFYHKLGTDQQEDILILSHPEHPKWLTDVTLSWDRRFLIVEISESCSPKNQVWIADLDSIRTPNARDAYDFSKLEWKKIVTNFDAGYEYLTNDGTEFVFLTNKDAPRYKLVKLDILHPEETFWKTLVHETSDLLSSADVVDGNKLILHYFRDVTSQLEVRDLHTGQLLGAIPLPLGSVKQISGERRFPHMLFSFTSFTTPSDIYQMDFAAAVKSGDWTPTLYRQTKVEGADLSQLEVSQAFFDSKDDTKIPMFIMHKKGLKRDGNNPTALYGYGGFNISITPSFTPSWVVAMLNLGMVMAVANIRGGGEYGKAWYEAAIKTKKQVSYDDFQQAAEYLISQQYTSPRRLAIHGGSNGGLLVGACINQRPDLYGAAVLHVGVLDLLRFHKFTIGHAWTSDYGSPENEEEFRSIFQISPLHNIGKARGKGQGHQYPAVFLLTGDHDDRVSPFHSLKFIAELQHSVGSSSKQTNPLVIRVDTNTGHGAGKPVKKSIEEAADVYGFLANVLGIQWHEQ

SEQ ID NO: 697 - protein, 460 aa, Neospora caninum
MEDGRDPYSGRGAPMPPNGDRYGREPWRGDRGRDRDGRGGMRPRDGSYRGDRDYGRGYYYGHGGYGQGHQAGGPSGGDRGHGGYGGGGGGGYGGGGYGGGGGGGGYGGGGQGGGYGGGYGGRGEREKPRSRSRSPGGRGGRGVAPAPPTRPRRNRDISTSRERSRSRERRRRRMQAECIRRAGGFQKLADSEGHEPIRLFWDGFQWVAKTGAASTQAGSDAATMNSTRKLRRLYFGNLPLHLGLTESTFQDVVWTEMKNRGFCNDPEANPVLYVWFAKDKGNYGFVEFSTVEETERALTMDGMLCMGIPLKVSRPNDYSTTSSAQTQAMSVMGQQAAAMLIGQLAAPGGPPAGTTRFLRIMQIVDPATLKEEEDYDDLLEDVKEGCEKAGKIVNAVVVSPKIKAQVPFELCDIILEFSTPQEVDACVVAMAGRKYMGKPLAMVRLEEASFSQYVAPLLSK

SEQ ID NO: 698 - protein, 590 aa, Neospora caninum
MELGSYSERQRQRDPLNVEQEPHVAAFHQGSSSRASALRSAFAGGWLGGGDSRNDAPGDDGEFSISGYSPYDVAYRGQAYGDSALISRTPQPDSKSRRFVFLLVGGLIATASVYFLYSRTPQPGLLGHTEGDPCVVDRSEACRAYPFYGGFDANVVRMIDADTTTKNFLFRSSMPLDSETHSLALHKVQMAAAEQAAGNGLQLPARAKILFFTLQWDGYNGPLLERCEIAREACQARPVPGVGTVHWPIFGQNVNPFRLPDDSRTALARTFTDWDADGLDQKVSILHQLVHVSAKENAAVFTTEDGKSVFSASPNEAQSGQGAQRDSVSAAKGGNGEHDDVSLTDDVPVISVIHCHHGVDRTGAVTAAYKMRFLGFSLDAVFKEARALGQNLVESIYSMMWYCLYLETALNLKTTQCYDVVTANANVPYFTNGRAPHTPPGVLPDPLPSPPLTPGPRVSEFLLGAEGRAGTRGSAPASKTKDALEKNGTESKAASPPSETAEKASAESAPHGEQKLHPDSASPKPTAASDPQVSPQPQLATHPVSSSPSADAASSLPASSASPAAVPQPAPSPPAAAEKTAAEASGEERH

SEQ ID NO: 699 - protein, 742 aa, Neospora caninum
MRRTHDPRLRTAAASWATPSTPAGRGSGSSFPSFFNLRDESEDGQTDVPETVDPLGREDAFRATGFASEQNENEGDLTPETQPVATSSDEPDGVQPEAGVDEEPPLRQASGDVKPDVNIPLSERTRESPVREAGDASVSAENLAGAQSQQSERETPSDPESPRSEQAGALPFGVPELDAESADAKGEASRGSSAYAGQAGASEEELNGVDPSSDEGQRAAASSDTDESFVVSPVEGTAGSNEDPSGEDSATRPVGRELTRDTRHVNQGIFAEDDTSLGALPVPLPQDTDLPNLETDDFVVPGNMTVPLYHEALSKSIETSRRTNGGRLPVIHLRWHSQESFVESAAQILNEEGKPYFYVVAGEYTQTPVRRMGFFQSSSVTSLGPLHWPIPTGENADLRESPFFLPRLDQLIDSSLNITSAVAITRAETDTEAKEHPERRERETLMLRWIPYGLTRIVEPGAQADGLSYGRNKAQVIQSVRDFVTALQRKMPNHPVKTVDGREVVVVVNDRRPELELLLGRAMDFAPSGTPVIVTDSEAFAPEAILPRIRLLSRAGERIHFVVFGVGRYGQLPLNAAFLDRAVLRVPRPADIDAFVQRHSDASAAAPAEETEPKQTAPGGEKKQNSALLSDEAPPASDNFLILNPFTEFLMRFNYTEVDNVAGYAEALTQELRHVPITFFYKNETRRVAVVLLTDFPEAESVFLTSLLKLNVIVQVTIAVAMIIGLLACLCMCRMMFLLKSR

SEQ ID NO: 700 - protein, 438 aa, Neospora caninum
MSRSACSSLSSQRTSRKGGRALSYLLLVSLCCFFLWSQNNVLYANGHGCCRGGGCGSASPSAPSGDSGSDGPTPVSVLLPIKLGYKSYFIFGDIYGKLYDFTKSLLGRPLSRFLRRRAQPVAYKVSTHWFQALLLQLTGAIKPQNGGAGAQLEQTTLNRATLSELAEKFEVITTTAWKSSGPETRMPVCHVGDKSCRSRIEEVLYTAMTLFYSTVLSTQGSGALLRNFKRVLEMEECPFSAYSDPDFVNAADYDGASETSEVNLRLAELGKKKYSSEICHRFRASVLAEMKTAGVTLEEQVSKMKAEKHGHSSYTLQDAAKSAHAKLSGEPSFGQASLLAAVRGEASALGMEPSDCCKKGDAVAAAIMAAKQSLGPVLFDAFLLKTEEELRTSGELCSNMQEAIEAAKKKEAEKEAEKESGTEKKECCCEEKKKAGKQ

SEQ ID NO: 701 - protein, 727 aa, Neospora caninum
MAKKIKAGTSGEAAQYMTRGQALKKLQLPLAGFRRLCILKGIYPRDPKKKKKGKDKIYYHTKDVLHIAHEPLLDTFRQIKATDKKVRRALGRKEKQLAKKYARSKPAVRLHHIVRERFPTLSDAVADLDDALSTICIFAMLPADNSRGVNAEYCVKAGQLLDEFLVVASQQRALRRVFASIKGYYFEVQFVGHAITFLMPHQFKQELPEEVDFRVLSTFFELYSTTLHLVVFKLFLLAGLAYPPTATKRESVRRKRRIQKNEEAAVKALAAGRLPRQQEGLHGDGPWGLAGWRYPILQARRIQDAEGRDAEDGPAKKTTGGPSPGESSVKSGGERKGQGSGSEKTGLSNAEEDEPEEGSELADETHSEEPDEETPGGSDSEGEDEESDTEDDGDDPAQAEQSTAAGSGREQKKARKLREAETGGNRAGNEDPVEEDHLGAETASACGVQPHPVQQLFNGCVIFLGREVPLLPFSFMIRSCGGKVGWQGPDSPFSEDHADITHHVVDRPLECLLRVENSQRDYVQPQWVMDSINTGIQLPIHLYAPGKALPPHLSPFVDDRKEGYVPKQREVLDRLVAERKGVAAVGLGSDTARGLDGDDADDSSGDEGAAEKERAFQTEVEREAEANSDSDEGPDSSTDATASNKRSREVIEASTEEQTSMPAAANLNGKARREQEEMDARKSLLRKKHKRLLERIEHGVRRKQQATAKLQAKRNALERQAEMSKGT

SEQ ID NO: 702 - protein, 468 aa, Neospora caninum
MQPRKPGDEAKQQAELEVVRKMMTPTRELLLELRESFLRELKRGLEMHKKHGITWVPEECSMKMLDSCVTNLPTGDEVGEAYAIDFGGSTCRAVRCSLLGKGKMHIDQDKICLRSAEHRCAKGFMDKQAGGKELFDQFAKCIRGLMARSGDLKKAEETNTPVSVGFTFSFPCAQAALNSSILIEWTKGFETGRENPDRVEGKDVAVLLADALERQKVPAVCKAIVNDTVGTLVSCAYQRVPGTPECRVGLIVGTGFNACYVEPEASQYGYTGTIVNMEAGNFHKELPRNEIDVEVDDKTHNRGKQQFEKLVSGYYIGEIVRVAAVRVFGDRVPERASVRHSIHGETASAIRDDHSEDKAASIQAIKECWGVTMDLTDIQCIWEICRLVFDRSAAFAATLATTLCYRTGRLDTGATVGIDGALYVKNQWYREAVEHYTQLVAGDAAKNIHYCIADDGSGKGAALIADVN

SEQ ID NO: 703 - protein, 833 aa, Neospora caninum
MPGVLSKDSSSPDAPASRASLLLALFRRFCPDKTRKRLFLAMSSLILCSSCNLATPTLLGIAIDAASNSAAASAGHPARGHLAATGGATLQGAGLFGGIGSVLSGVCTAVGQVLRGGGKEALKNQPPKVLFTLIAAVICVGAVASFVRTSQLETAEHEMRVEVRRQLFRTLLYMPPSLFLFRSPGHLLPLFLEDTEALVSAFTQTHAQALRYTSSVVGGSSLLLLISPRVTALALVLLPLAGCSAMLLAKRLRRLRGIREKEVQECTAFLSDRLFHVKTVYIHQEQEQELFRLQSRQDQALEAAKAAAIANGCFFGGLSFSINSTVLALLTYGTTLVKRGVLSYGSLTTFAVYSSMVGVGFSGLTAVFSELARAAEAGERLHAVLSLGDGASALAAAGDRAEGSGNTLDTAETAARLPLVRKISEYQEGRASAGQVAEAVVGEIAFANVSFSYAGTGDFQEGLAQASPLASLVPSLAASPAEARSSSEDGGEGAMPETGEGVETPEPGAGATAVKNISFVVPAGSLTAITGASGSGKSTLLKLLTKQIHPQQGTITLDGADVQAIPTRLLLQKLLGVVNNESTPLLTGLSVRENVMYGLWTPPGSPPCSHLPPRTDENRPGVTPGEAPSSSSASSSGSLACSEELFAEVCRLCNIDQFLSAPNISRENMLVEGTNAGFSTGEQQRLGLARALIKNAAVLVLDEATAHLDAENERVLLHTLRRVLRKDQRLSESESEDDREESAARLLKGAVKTVVLIAHSKAALQMADTVVVLKEGEIVESGPFDALIKNNGELTRLLKLQGEPSGEDTSERGATDGAEAPQLVSQGSWWWRE

SEQ ID NO: 704 - protein, 363 aa, Neospora caninum
MDQGEKPCNDRSPGYRPAPAGTTLFLFPFLGDVCSCCSSCYDCCGKCGCCPQCCTCGPPCPGCYYNMPCLCCCCRPVLPGKHIDEDELVPESTAADEVLKDIEEEHFGEEAGEEEEEGETAPPSEATEVTGAADVLPVRTRVAAKKRAKAQPKKHAAKSQPKMFTGSAAGAPPPPAEACTGPLPEPEEPATPLGMGVYLVYSTENGGTMYMKWSKTPLSGPGVLAYIEPTKEVGAFKFEKKDGVEHIGSGFEQDLQSSFVADRKKYYDGWATFLKQMDAADGTLVLLPAATLQPPPKVKVVVLSHKKMRVLEADTRLPKEDVELMAVVPATVVKFDVPTMEVGEFAAFANNYGSLISFVPAKK

SEQ ID NO: 705 - protein, 350 aa, Neospora caninum
MYHGPSPLGPTMLYHQPDGYAPAPLGPAPMAAASSHQHSSTSPRGYPASPTAARGPAGLVPSAPVGATPPRKSGNACFLLAVVLLLSFLYLGYVFILLAPLLWPYPSMLGFVLFVAFHCCFVLLLGAFLKAVCTDPGRVPANWGFYMGDENKRRRYCKVCNVWKPDRTHHCSACGRCVLNMDHHCPWINNCVGFYNRKYFIQLLIYAIACLFFIFIHGFYFIFVESIRSTQPHSPEIHALPYQTETSAAAVLKYVYVCLMLFFSMVLIFALIPFSRFHLNLVLKNSTTIENMDVANRDRNRYDLGVSRNIEQVFGSNPCCWFVPAQFAANRPVGDGVRWNMHYMVADEQV

SEQ ID NO: 706 - protein, 189 aa, Neospora caninum
MASSTASSPQVEAAKTAELAGSSNSSLSPASSLPSSVSQAYNDSFFSRLSSNLSSYALACKNVSSVSDWMQLNNKYLGSSILYTDEISAGLIFGYCAGYAVNRALRFGALLCGIGFISVQTLSHYGYIRVNWKQVEEDIMKPLDVNGDGKFDHEDIAVIKNSFMRMMAQGLPSTAGLSFGLLYGLRASK

SEQ ID NO: 707 - protein, 730 aa, Neospora caninum
MAFVLTTVKLPSKDVAFTNCAYVNPRVYASLRQTAASSGDASGHALLCEVKNIVVSVMPDELLQENEIGLNTCQRESARIQLRDEVALRPFQLPPDREHLYQIGVMQIEVSTYLKPESRIVVHDDKLEEEFRSLFCRQVFTQHQCVAVKLDEKQALKMTVKEMLPFEGASRQSSRLLTRGQLTEKSQVLFVGADDGRVCVQSRRMLQRNILTPDFNFEELGIGGLDKEFNEIFRRAFASRIFPPAVVQEMGIKHVRGMLLYGPPGTGKTLIARQIGKSLRAREPVIVNGPEILNKYVGQSEENIRNLFKAAEDEYRKLGDNASLHIIIFDEIDAICKQRGSNPSSAGVNDSIVNQLLSKIDGVEALNNILLIGMTNRIDMIDEALLRPGRLEVHIEIGLPDESGRIQILSIHTKQMRESGRLGNDVDLAVLAAETKNFSGAEIEGLVRSAASYAFQRNVNVKDLSKPTDVETIKVTRLDFENALTEVKPAFGAEEDLFDTQSAQNVRDSENTQVLSILLHGPPGCGKTALAAHVAKEAQFPFMKLVTPDNFVGFSEAARTNSLSRTFDDAYKSPLSLLMIDNIERLIDFTPIGPRFSNAVLQALVVLVKKMPAKENRRLLILATTSEFEFMKEAGVAKAFNVSLQVPLVRGPHQIRTVLQAHCGDRHVFPPEEIALVCESGKVHDVSIKQLLLVTDMAKEFSKPGPIKCGPFLQCLHDCGYEGGFDAMPF

SEQ ID NO: 708 - protein, 848 aa, Neospora caninum
MSVYSVHPAAGAPASSGGGFHHSAQNTAFSGPHTYGGTSGLHPSSGGRGGYGQPHHLQQQMQLQHLQQPPLPPPPHQQYQGFTNAGNYSQHSAQSAQQLQQGHHPHAYSQPNAATAMSAASTLATPTATAPDASLLAQQGSTSTFMFPSQGAAGGAPAAGSGPSAPLMMDAQGAPLGAAQVSSSVAQGPETDHGAHAAKPRMLTPMEVAHSFVYQYYYMLHDTPLDLHRFYDFDSQMIRTTDRDGTVPHSAPHHTDVRAMGQREIYRAFERGRFERTTCRVRFIDAQENKDGGMLILVAGRLKHADEGPEREFAQTVFLAKQKAPRNGWYVTNEIFCYLDAAVEEVQNGAREAALPSSPSARSRVSEAPTAGFQQAVRSPTAATARVEAHAATQTLAPEQSSPRGSAAGSPRAPNAVGSPRVGSGDAPASPRVVPLTPAVPTTAETQETGDEARKAAGEGKKEAGAEEAKSNSAPSAEAENQFLAPQKPAPKRQWKREDAPSPEASAPDANWPRPGETKQQAQKADAQQHAEQFNYDPKSFAFKVVQNAQRTAGGPKGFAVPATRSTGSAASNGRAGAQEEGRTSSRSGAAQASPGAQGGEAGAEGPARGDGPPAGAKKLVVLSEMPPEFSVDELKKAVADQLKKFNEGQAVEIRKPASGRTFGWFIELDCRQSAEYLMQQGLYVRGRQMRLDFARQQGSGGPRGGGARGGRGGRGGWNAGKAPNGRGEFYGPKGDQGAFGEEESRFQRPRYARGEGANENGVFAGSASGQKEGETGADGGGQWIDAGKKKKGPGGPGPAAGVQTGAAAGAGQGERRFGAGGARGGAGRPRGGGSRRGGGDQQPSWSR

SEQ ID NO: 709 - protein, 669 aa, Neospora caninum
MANAQFLKMMDDDLGTEHATAYIALGSNLHGEARLGIIEETISEMRRCLGPILGISCLYETIPAFDVCPKGVVHDLFHPFYLNAVLKLRTHITDPWNVLEILKDLEAKGGRALPAPEEVESLLNGPTSSEPAKEETEQGGAAVPQNGGSKEALQKKYVRGAPRLLDLDLIFFDKEGKSCVIHPDAVRPADKKWPLTLPHPRMVTRNFVLFPLCDIDPEYVHPVEGVAVKELLRINLERRRIRLLNAAEEAKTHATQTHTGIAENPNGADLCAKGKPPRASLQFVHGYTIDGSLAIPRRCFAATTEQLWTLGGDAGVVDTLRYIEDVKRHADEKIKAGGDDGLTEAQRRQLLRVHRLEENLRQEHPLKVMGILNVSPDSFSDQFSASVDEAVAAAETMVEDGADVVDVGGEATNPFREAGGVPLAVERARVLPVVKKIAEQLKNRVIISVDTMKAEIAREAVAAGAAWVNDQTGESRTRADGDPLASVVDNSTAIVLMHKRGTPDTFDSYQKYEDVVGEVGSWLANMSEALQRCGVGRWRILVDPGLGIAKNPEQSFELVRAVKRIKQMLPTGIPMLLGFSRKRFIGWAVGETSLTARPTPDAVERRRWGGAAIVAWCAANADAVAVIRTHDVKDACTVRDVAEKIHGVNSPTGWLDKQPDMSSLYSFWN

SEQ ID NO: 710 - protein, 642 aa, Neospora caninum
MGRFSRFASCSAGVLGLGGVAAYAGLYYNHRKSMIPKETRYYASLPVGQGGAIAHLPTSREEMIERMKKERFDVLVIGGGATGSGVALDAATRGLSCCLVEREDFGGGTSGRSTKLIHGGVRYLEKAFEELDLRQLYLVWEALEERAHMLAAAPYMNHPLAILMPVYKYWQVPYFWAGVKVYGLLSKLVCCFQTGVPPSSFFPSATSRFSFPLLPEAGLKGSLLYFDGQMNDSRMNLQLALTATLDGYVEGMKGAAVANHLEVISLLKDEEGKVFRGHNDAACVVLFPPGPFSDAVRQMADPTQPKLVEPAAGIHIVLPHWYTSASPYGLLLPKTTDGRVLFMLPWQGATVAGTTDAPCELSDSPQATEEEVAWVTNELANYLKLDEKQIRGDIRAVWKGIRPLISHVPQTKDNSSVADAAKDGHVSTSNVVRSHYVVVDEKTGLLSVLGGKWTTYRRMAEETLDALLTAHRDKVAATRPCRTKAMLIQGAVDPTGALSSKECIPASGVLELELEKANPTLSFSQVRHLVESYGFLARSVCEIAKERPELAEPLINDGAFPFLKAEVVYGVRHEMARSVSDVLARRMRMAFVDAPKAEACVDEVARLMGEELHWDSAQVAKKKQEAVAFLKTFRYLPASEAA

SEQ ID NO: 711 - protein, 384 aa, Neospora caninum
MAQNTLQVHDSLRLLSYDELFKSSEVKTIQKFQGFKRQNTLKGDTRAKNELLSVLRQQRVLVDDNAIHFIAEARSESKADARNSVFKLAQKYKVLPDTENVKKIKQLFGKVREDDSGDEDWEPSFRRLPDCLKTKRGVKLMEDDVSHEILLGEIDTIEDESSKLGGNVVTLEPVKEEPEEVMGRVIDEHAGELGLSAGKEDGTAQAKAQNEESDDDDEDDAHFDNEDLKVLNDMQKEFIGNNLTAWIKDIKKAYESGVKLVKVNALGYKFIRIVTLKDMVLSIRQPHTQSKVKLERQVAITEVINVQLGRDSKEFRALDQLVDEGKEPADTNPTATLCAVVDLPKNRSLSLVFLEEDQRNGFVFYLRVLLKKAKVAAQQLEASP

SEQ ID NO: 712 - protein, 482 aa, Neospora caninum
MVPRLSSFFLTLNTGPTAPSAASLASSPSALAEASSSSVASTSAIEQVPLRDPLVNPTFTAQKIPKDYVKKTLIPHLEHQITVVAKALNELELANLAAAYAKLPPSLRHPELCRELVEKVKFRMNGFGAQEIVLILHPLYALVGDSDKELWCLFAERIEKEFILKELSVLNLVSVLRVYEKLEGAFGDEFGVFVATLQELLKTGIAQFDAIELHDMIVTLSLNHRETKRDLQLLRFALAEMDGKLHALSLLNQLSLLQALIRMKIEHRELANLVAAQLQDARKVHNIPPKFVAQTLWIFAKLGRLSDVACTMGPLMEQHINRFSVVDFARLAQALPAGSSVPLRVCKNLQERLSSMNVKDFCFFLCACVRLNLLPDQHGRIPYFANASDDENAQGLLAGNSTSLVATINAAGLRDALLSFMHARESEFRCEEIRRVVLVLQGYSEDYGYLLEKLPENWSDIDESLDTMTDRADAAPKTSQGA

SEQ ID NO: 713 - protein, 1139 aa, Neospora caninum
MPKHGGRDAQLGPSHVEGAALEEGHSPAAEEKQDTASAVTAARDSIPTNVSGNCRRPCPNKMLSFALFSLVFLFFLSGSHSLVSSILSPRGFRGAAEPACSTLALTNLLHESPAQALRALQNFLRTPVSPPTPSSRGLRNAKEALKATEREEREKEQDEKEREEKEREEKEKDEKEREERREMALSPFFSPLVVGVLCAAHPEKAQIVSQVLGLSLRGSAAEPRGSERENGRLSPGELAVEGTARLHGEREQSFFASLEHLPGASPAVLLRLDFARTPFSPPTTEEGEGALPIDAPENASSTLAALLRSDGTAAEAASWARILGHVGSVALLPLHTGQLRFFPAAAHPAAAAGVSRSQEEDNPCTRNEARSPPGTGDTPPLAVELPDEVAVILRGLGRGLEERAREAGRQQPSGGEPFRIVVLLMDTPDENWAALASQAVAHAVEEVVRRRETERRPAAKNSGEKDSDGVPSSQPASPLVSARVLPVPPLSLDSSSGSPAIAFGLENEFRSLLDEARRTHELRTRERQERLAAHAEKAAQAKKEEGEKAAETTRRKVKEERQAAKNRAGTKGEHDEREDGERARRAGDVGHGNAVNEAKGENEAATSPRSLYTGKKDEEELWSQAYDTLPDILVKKLFPSWAFSSPSRGERKAGEEALPTLPQEVQFPALLAPDVLSWKVHERLLAHVTPVLQKWRKRVEIEGKMIPNFGKEAREILQTLLPLFDAATLAAVNTPARLLARRDLQTLLQDELRHLYLQQLMLLERRTRVRLRAALLAALKAFPPPRQALRALWSGENEENEVAAARERMHRAAEEVLTHLTNEAATLLPSLSIETVERPEALAAFSRFSADFRSAWRLPAGEFAEHAKERIRAVSRKAVAAFQANTTSLSERLKVASWMRAGVQRTRAFVSRITKTTMTSPSSSPSSSPASSSSASPSSSCSSPSSPPSSSPSSSPSSSPSFSPSSSSSSFLASSPLFCGRDAEKTASGSGAGGALEGEERLSEQVQSRLKQAASAAFEAELAKLHAALMGKLTDSLRELTEEFGASPLADKIRKQSSFLGGVSLREAFRFAVRPSLSLTAMLRRRGEGNVQGFFAYNTGPLNMILGNDAPVVQPDGKLAPAFRLQPKVHFDVVRSPST

SEQ ID NO: 714 - protein, 70 aa, Neospora caninum
MATPTDLAGLQQALNKNDKFDLTRTDSFVEKAEELLRQQLPEKHEHDKEATEKMVAFDRRNSAMSLDNAK

SEQ ID NO: 715 - protein, 92 aa, Neospora caninum
MFLSRLLRLEVPIPRFTKDRFYRRFNMIEMDRASFYYWNLFSIAVTALPIAYMTTVNYRFCEESIMLSERSKGGQLPSEVDRGLFNSEKLAR

SEQ ID NO: 716 - protein, 232 aa, Neospora caninum
MVFLPRLLADLSFPFRRTGLGAPACLRVPTREAFCQADHVGPAFRARFSAGKEGHASTSAGKDLGSKALAFCRESAPWNFARNRGLLGSGSAGNGLSRLVTGRATGAVAKALSCLHQQPRHFTGPHGTHSGAPSDKPNEAGKKRGPTGLQRPCDLTGPLATFMGKTEASRVEVVKHIWDYIKRHNLQSPENKRMINADSTLRPLFQKDQVSMFELNKLVSKFVQSRPSPPKP

SEQ ID NO: 717 - protein, 107 aa, Neospora caninum
MSVDGGEGAPPGAQQPSMCQDALERMLDGLAVVGRAFRGVYTTSSSCVRRVSYSVKETVVQHWDRCTGNWDTEASRPPKAREGVVYFSGGEESDYGASTSRSTESSA

SEQ ID NO: 718 - protein, 84 aa, Neospora caninum
MAKEIRDLRKFLLTARRPDAKRVTIVKLHKKPRATGGGASTVTKFKIRCSRYLYTFVVEDREKAQKLEGSLPPSLQKVSIPGKK

SEQ ID NO: 719 - protein, 182 aa, Neospora caninum
MATLRRSVTSLLATRSPVFPSSAVSFSSCSSTSPSFIALRPRFSPGATGALHPQAASAETGNRLCGGFLQVRTVVNRVKKVEDFQKVTDSHEDTAVKVVQFSASWCGPCRQVTPTIEGWSEKMPSNEVQFFHVDIDECPELAEEYDISSVPTFLFFKNGKKVSTVLGGNTAKLEEAIKASTN

SEQ ID NO: 720 - protein, 294 aa, Neospora caninum
MHASLSEGAWWPFFLAAAVAATLPLSANAHSAAQLHQHVLSTSAGHAPRCSETHPELCSPSLSLSLSTSPLDREGSGLSETLSKTHAGDGSPASPGRGEWERCRAASSSLSSQRTLGPGVHSTSACSPSASPLPPVALAEVERVTGAGETVSPPRETAATVEPSKPAGDGRTAGGAQAGTASPVSHATGAAGSPKMMSFMEALGRAAAAEAAALGGGAWDWSTWGVGAFREAARGQEAGEEKVEDKKTQSAKSEAPLWGGEWREAVSNFFAKVDKRIAEANGMLHYTDLNGYLL

SEQ ID NO: 721 - protein, 171 aa, Neospora caninum
MPSVPIRSFFFYVLVTTVVVVPQRHVTAVRLAVSTGLSRKVGGAGGAPPKEDKIGVAQHTAADMETLIQQISTIDEENETRIYFINLGGSSRKELWKHGEDIKKANEQRRSLFDKLLSLLVDLKRLIAELQDSDPASTQGATSDHLTPLKDTVSRAEEVLQRGPSGRGASP

SEQ ID NO: 722 - protein, 237 aa, Neospora caninum
MRGNIRGFAIAWRAEGGFLLLRSEKKSKGLHYQLPGGHAEFPGDASRAAQFLQSEASSRAFFLSAPSSAEAAGEQRKKHVDEEEVARAACARELFEETGIDVGEDLGSLVPLAPAGVGPYNNRFFFFLHLTDKLLADAPRALQSDDAEKQTANGNTRALLYPENRDGHSPPLDVQLAVGLDEHTGFRFVDSAEEAAELVVKHAGGRSTKALKAFQKLLNKHAPLSPLETVRACTDTS

SEQ ID NO: 723 - protein, 408 aa, Neospora caninum
MGIEGANSGASARNADGGNRWCLIESDPGVFTELVEKVGVKGVEFDEIFGVDEESFQALKQRDRKIFGFVFLFNWTKDAAGAAAGEAADAGGEDVAMEDALSAAQSHPDLFFAKQVIENACASQAILSILVNKRDEIKDVGSTIRALVDFTKDFLDPQMRGEAIGNSEHIRAAHNSFRSSSPFDWTDDDDEKEKEDAFHFVSYIFFKGNAYEMDGLQPGPKNLGSCDESSWTEIVRKRLQSRIAKIQKAASGELRFNLMAVTEDNLSKLQEDIFRQRAIVQRAKVKLISSGKDIELDDEVDDDAAPAGTPTIDELPDDIAALETVIQEAEDRKKLLKVQEEEELDKRARWKKENVRRRHDFVPFILSVIQHLAKKGELVNAVKAAQQSVSRRQQERKKAKTGATGVSA

SEQ ID NO: 724 - protein, 216 aa, Neospora caninum
MSDAATETKPAQPAETAATATKEEEDNFNPEEEVTEGNWNTPQVEVHAVQVETGEEDEDVFWKYRSKLYRWVGSTGDAQTAGEWKERGIGDAKLLRHKQTGKIRFLLRQEKTLKIVANHYVVANGVYCKLTPNVSSEKIWVWTVMDFAEGELKNEQFALKFGQVEQAQEFKKKFEEAAALNAKIFGVDADGEEKEEKKEEKDEKKDEKKDEKDESK

SEQ ID NO: 725 - protein, 416 aa, Neospora caninum
MSSATVLQRPPEASPSSAELAAGESAQHSRDLYAQLKALQKRLEFLNIQEEYIKDEQKNLKREFYRAREELKRIQSVPLVIGQFMELINANEGIVASTAGSSYVVRILSTLNRQERRIELLKTGCSVALHRHSHSVVDILPPEADSTIQTLQMQEKPDVTYSDIGGMDIQKQEIREAVELPLTCPELYQQIGIDPPTGVLLYGPPGTGKTMLAKAVANNTTATFIRVVGSEFVQKYLGEGPRMVRDVFRLARENSPAIVFIDEVDAIATKRFDAQTGADREVQRILLELLNQMDGFDQTTTVKVIMATNRADTLDPALLRPGRLDRKIEFPLPDRRQRRLIFQTITAKMNLSDEVDLEDYVSRPEKVSAADIAAICQEAGMQAVRKNRYVILPKDFEKGWKAHVRKHERDFDFYSF

SEQ ID NO: 726 - protein, 194 aa, Neospora caninum
MDSEVFGQVSPVPAEELDMLKMILTPYEGKIIKHTPETESAVVFFPNREALEALKDIPSYKTVEIPRPQDETPQSPAPEPAEEEKIPEGEEAQKDPAAAAGEAGGEHGEEEATPVEDEVDQTVAQNVVPEATAHAAEQTPRPQTAVETPAVEGVKRKPLPANDVFYLFGDENIVVPTWCIFLLAYSVLAVFGVC

SEQ ID NO: 727 - protein, 289 aa, Neospora caninum
MESAIRERVEHWFAKRRGEDGEDANGASSSASGKDEEMMKAAGEEMVELILDGRQFKSVGEEAAALLQKLTVLGKLTCNQTGLHSIEGFPVMPSVKTLELTDNHISGGLEALVKSFPNIKRLQLGGNYFRNFEVLEPLKGLGSLEHLGLDMSPISNQSDYRQKVFEMFPRLLVLDSTDKDGKEVEAADSDEEDEEEYDDDEEADTTLKDFYEKDLEDEDEEDEDDFNPDGEEEEDEDFDEEEEEDGIEGDGAADGEEEDAKDADGKKRKNDAAVSGEGENDSAKHPRLS

SEQ ID NO: 728 - protein, 630 aa, Neospora caninum
MLFLLADFGFSHVHASTEEENKPLVRLDPATLPRYNLTRHFGYTSIFDPRIDEDIEKLSRQAEAFNKRFKGTLDSALSEALEAYEEVDEAVDMVDYYVALVSAVNTTDEAIRQRVNQLESRMASEIQPHLLFVSVELASLPEAAIEKQKAANDNLHFYSGFLGAARRRAPHMLSESVERALMVRKPLTVTTATDYYFKQLDDATFLMQGERMILPQVLSFIMDSQQERRWAAQAAVKQGLQEHMITKFGALSLNIVLGSWYAERKERGYQTVRSSRNVSNNVSDATIEALIKAGETVAVQLTKRYYRLKKQILVKKGALTTFDFADRLAPLPLKSSGHVFDWEESTNIVRTAYSSFSPTMAKLFDQLLDEERIDAPAVPGKRTPACYLGTPTTGPFVVLQHVGQQHCVETLAHEAGHAIHSILSYEQGNLQHVPPLTVAEMASLMGERIVFDSLLGRTTDPEERLALLLSHIDGWTSTVTRQLMFDDFESRVHEARTQGTIPDGAFTAMWKEALEKYFGAEGEVFDSFANAELDWVRIPHFHRQPFYVHAYAFSELAVGSLYGVYKTSPNGFEQKYLDVLRSGNKKSFEEIMTPFGLDPSVESFWADAMKATGGAVMDQAEALAAELDLI

SEQ ID NO: 729 - protein, 480 aa, Neospora caninum
MTIDVNLLRAEKGGDPGLVRDSEVRRGRSGEVVDQAVEVDRKWRENLFQLEQLKKELNAVNKEIGQRKKKDAKDPCQDLLTQAAELKQRLPTIEAAATQAEEKRESLLHKIGNIVHKSVPVSNDEANNQVVRTWGTFDRSIKIDGTPGRMHHHQILARLGGVDFKKGVEAAGHRGYFLKGAGMLLNVALAQYGLAFLLRKGYTPVQPPFFMRKEVMARAAELKDFEETLYRIPHAQAAAGAPADKAGAEKKNEKDADRDDLFLIATSEQPLCSLHMGETLEEKELPIRYAGYSSCFRKEAGSHGKDCWGIFRIHQFEKVEQFCITTPEESWKMHEDMIGAAEEFYQSLELPYRVVSIVSGALNDAAAKKYDLEAWFPGYEDYRELVSCSNCTDYQSRALDIRLAHKASTAKGADKNEKGHVHMLNGTLVATQRCLCCILENYQTPLGVKVPRVLVPYMGGAEFLPFVEGAGEESVKKESA

SEQ ID NO: 730 - protein, 298 aa, Neospora caninum
MGAAASSPGGAGASQAGLGSGDNQTPSAAGRDLFASAVVDVPSSAGVKHVVILGNDFVNNFAVFPSQTSVFPPHQAKKTNPNKTMQEELKTDSPGPVVPRDDPSADLVQRHKMAGTERLGLEQSASPGETPFLGEKGDSLSLGGGQPTQAQGPDAAAMATQQKKELLSDMRNHLKAALVEQMTVLRQGLAACPLTQAAASAASATADASLRQVASVLPEERETVSPGSWSEDIKSVSFPRPTCHDEQLAVLQCYSRQRKGEKEGRADYLSCHSVVADLRACSERATQLAPLTRQSAVN

SEQ ID NO: 731 - protein, 177 aa, Neospora caninum
MASEEGETAASQKMSYLSPIASPLLDGKSLRRSLKLIQLAADRERAARGGKQSKEAEGGKKPQGGKKGVKLLRRGVHEVTKCLRKGVKGIVFFASDVFPIEIIAHLPILCEEKDVVYAYLCSKKTLGHAFRSKRPASVIMITPGEEQPEADGEDSEEKFEEVYKKVAKLVRKSNPYF

SEQ ID NO: 732 - protein, 802 aa, Neospora caninum
MRIHLSSDEVNLLVHRYLLENGFLHSAFAFSAEAAIPKNPFHVTHAEKLPPNALVTLLQKALLFIYIEYHTEDETGRAIPCEEAFSFFKRHECWTRREGSEDLAASAASGLLATLAAEGAGTPRNAPAAASPSHLAKSGSEPGPESAGNELDFLPGSLLADDERAERTAERPSALRGKRATGTSVAASAWNRGGGGGPRGKKRARIQYRGATAGDGPGSGELPDALTGSVQNAGGLVEEEDRKESPHEGDGGTLSGRREDEEESEDAPPVARNETGEDTIFEGPPAHACEEKVALKNFIRLLPGQDGDAGALSEWSPADPCLIVTNFAAGSPWLYRLPLNIVGPGVLAPYRELDGPRVAGALNPGSSAHWKRDGELVATGYESGDVRVWRPLDSPFVASLSVSSTSVICTAFSCEGTYLAAACADGTVVVWKLCRDEAAETREKGGLEVGSKSETNEATSGPKASEGSRREEGRDAESGNDVSFVRVHAYRHRGGVIDLDWTRDCVIASGSVDGCIVVTDFQEGVCHCLSLGDVSPSGGTPRTVTTAVPFANSTERRAEKGGTGGSAPSPKGRRDEKREGQDAEDARDSGEALAVFPEKPAPAELEAKKEDRKGDAQKETLDASGSEAEVASLRWNADGTFLAIVDSSPVVKLWRLDVPQAPLIELAAHAEPVIKAEWRDGGRDDDQHFLVTVAMDRQLLLWDLEKSKDEPAKNIVYNYPPTSLRISGDGSRLAVGTYDSMVHIYALPSLTEVASLIDPHMVIPHITWRSTHDSIAYNVFNMNRTIVAKAEKPGAGKLEASA

SEQ ID NO: 733 - protein, 224 aa, Neospora caninum
MLVLGSKFPDIHADASGVPDNKMKLYDFLGDSWGLLMSHPHDFTPVCTTELAQAAKMAPEFAKRNCKLVGFSCDSVTCHKDWAKDIMSVANLAGDLPFPIIADPERKLANDLGIMDPEEKDQAGIPVTCRAAIYIGPDRRVKALILYPVTVGRNFKEVLRVLDGLQLAEKYPVATPEGWFPGDKVMVQPTLSDEEAKAKLPKGFEKTACPSGKNYLRFAPDPSA

SEQ ID NO: 734 - protein, 377 aa, Neospora caninum
MRVSSQMLLSLSDSLRRSGWRASFLFSSGPWAFNCLLRLFLVRCGCLLLRWPTTSLFFQGEVLAVKFSPDGRNIASAGVDRDVLIYNVYGEIATWQTLKGHSKAILDFRWSTDGSQIYTASADQTAAVWDVETGERLKKLKGHVGIVNACSVASREAAECPNRATYGCASLFVTGADDGTTRVWDLRVRRSIKKYEHQYQILSVALDGHGGRVFSGCLDNTIRVYDLRGGDAESEVYEGHTDSVTGLSLSSSGTTLLSNGMDHTVRVWDIQPFVQGGKRHVAALRGATHNFEKNLLRVCWSPDEQLCSAGSADRHVCVWTVNEVLRDKGTGNPANLSPLLYRLPGHSGSVNDVCFHPTEPVIASASSDRTVFMGELS

SEQ ID NO: 735 - protein, 299 aa, Neospora caninum
MTAKAASSRDPPEPRGEKGAKGEKVGKKGGKTSLYDLLGVQPTATQSDITKAYRNLALLLHPDKVVHRLEQQEKGKKTESSLEKLTAEATQHFQELQAAYEVLKDPKKRKRYDETGSTGDAPESFEEAYEYYRRVFPEFNVSDIDSYRDVYLDSAEEVQDILDFCLRFQGDLTHFFEYIPFSDKEHLPRYLRILDNLVETKKVKKNKKFVDTLKHMEAQAEKHAVLVEKEGKQRAKKTTKKDDGMESLILAIQSNRQKRAQNAKDLFARLEARYGDMEEEAEGSRKKAGQRENKKRRKN

SEQ ID NO: 736 - protein, 543 aa, Neospora caninum
MARQTTRRFFGALACAFGVVLAADLTAPVGGTTAVQQLNKLFLHLKSRNEILQRINAIRAEAARTGNALESDTGAPFAGVELDEVCVHPELIGDDVLKVMSAIKDDAEQRAEQTRKRSDERLAALECAPEKALESDRQAARAFRKLAKKQLEQILAANIEDQTVFLFGASSEVFVFAAKARRVIVIEKDPDACDKFLASALGICSLKDNVHIFCMKHNSLGERERLMAFFSMAESLIQDQYSDIPLDVLHSDMNYPVALALKIFEEIDQSTTLVLRHRLSHAALEVLGKYYRQVLLVLPDEMDPDVTNSASVLLLRKKYVPDPPPNLWESFVSPEWQLAPREEPMVLFRDLVSQISERFQHELDELENTRLGIQARAIRSHYHLATDEERQGDIAFLDELRTTLDNPQTHFATVQELFRRRSQEVADIERSTSVLKEYFEPLDKAIAAMPEDSMKHLLQDMQNDFVVATNRIDTTDSQLELLEDILELLNPELFTSSQLLPKSLHALRLAVASLNIITDAHAIVRDIEETVFRGVDPVSLVKA

SEQ ID NO: 737 - protein, 499 aa, Neospora caninum
MSPQPVPPVNRDLSGFTAAVGGEQDEADVTMLQSATPRGDPKHGEVGSRTTDMKPRALATQDPELYELLQQEKERQVSGLELIASENFTSQAVMECLGSCLTNKYSEGYPGARYYGGNEVIDRIESLCQRRALAAFGLDAEEWAVNVQPYSGSPANMAVFVGLLQPHDRIMGLDLPSGGHLTHGFYTAKKRISATSIFFESLPYGVDETTGLIDYEELRKRALVFRPKLIICGHSAYPRDLDYAKFREIADAAGAMLMCDMAHTSGLIAARLLTSPFQYCDIVTTTTHKTLRGPRSGMIFVNKRRVPDGEGLINSGVFPSLQGGPHNHQIAALACQLKEVMSPSWATYASQVIRNSRALAARLQHHGHRLTTDGTDNHLLLMDLRPDGITGTKMQLCCDEASITLNKNTVPGDTSAANPSGVRIGSPALTTRGFKENDFERIADWLHEIVVIAQEIQTKYGKKLVDFKKGVPEHPHLLEIKQEIAKWSRSFPMPGQTDI

SEQ ID NO: 738 - protein, 334 aa, Neospora caninum
MAIQALVVDMAIYSHPNVRIQALFDGHGGPHVAHYAANHLQSLFAKHRSLSRQTIEKICNDLDEELKMYKIIHSGSTGVIVVIEKVEKPEQVTVRGRQIVGDPAITPLKEEYGQEASPAAQITLGSPDAPFRLYVINVGDSRAMLLGGNDYYEMTKDHKPDDPEEKSRIERAGGFVTDETARSVARVNGLLAVSRSFGDFLLKEPGSGDTPVISKPDIRYFFATYGDLLLLFCDGVTEPAEMSWAHVAAFARETFSQTNDVVKTATFLADKAYAAGSFDNISTIVTSLRQEPAAVPVATLQAHVWTRDKLITTLSEDWTHRLETAKSNFFLPLF

SEQ ID NO: 739 - protein, 183 aa, Neospora caninum
MEMHPRNAGRKPLLALAFFMATSVASSYGFVSPGLIRFNYRYGTCPNMSAGVCATPSTAYLGTLGQPVGILANRQGPFRGVGTGALGSPSSALFAADAADSDDRPLLERVKDVVADQLGVDRARIAPESNFIKDLDADSLDSVELVMAFEEKFGVSIPDEEASKIATVQDALSYIEKAKSATA

SEQ ID NO: 740 - protein, 190 aa, Neospora caninum
MASNDGSQPAADHRATVVSQRSPTRQSGVDPQTSLAHQLSREASFGMPSAAAPENPVRQATLTSMPSGISRSASLRYAPSSISVAAMNLLEEMANDERVALANESGDYRVKLTGPDGEISVNIWDLSLYPLWPFDHYQSLRREYLEMRGKPDRTPEEILTTRFVRALSSPMQEASAVHGSEVVDNPDQMQ

SEQ ID NO: 741 - protein, 285 aa, Neospora caninum
MAEGSYMVTGSVEHPERLVQIEPHGHWRRIPEHEQFSCCDILTCSCSSLTKGSPEKIRNDETTAAPLRHHGVLRRGVRKLLHFQETQNLRQSVWSQAHPANRQIQAALGTCVLGQQVADDGSPEPPVAKTLQAAPQEPAPRTDACQERFEQAAEAAPEQKKAATEKPEAPEQRQEVVVAKLKKPQPPEAAETPAKPEQRHEVAVTTAKTPQDTHASHLPYMTKEQAEAKGFTITWYDPEDTYNPLYFGVSPEDIEEQKALDERTVYLVFRLPKVSRPCFDPAIRR

SEQ ID NO: 742 - protein, 314 aa, Neospora caninum
MAGLPSNLRGLLQQFGGMGVGPPNRDQPMADTSEQVYISSLALLKMLKHGRAGVPMEVMGLMLGEFIDDYTVRVVDVFSMPQSGNSVSVEAVDPVYQTEMLEQLKRTGRPEMVVGWYHSHPGFGCWFSGTDVNTQQSFEQLNPRAVGVVVDPIQSVKGKVVIDCFRLINPHLLMLGQDLRQTTSNIGHLQRPTISALVHGLNRNYYSIVINYRKNELENQMLLNLHKNKWNDALKLKPFDEMAAESAACTKSMKELSEQYNKMVQEEIKKTPEQLVVERAGKVDAKKRLESDVDTLMTENILHSLGTMIDTLIF

SEQ ID NO: 743 - protein, 578 aa, Neospora caninum
MDATYTPRNNGSFAHRFSMPFTQRSVRYSSSLTDPRDNDDCHPAAALLEAGEAVSGRAAAAARIRKNAYSQKDARGADYDGEDTYHPEGKARFRGLSADPAAVFEQIRQATRMWVTIAACLLLLFVAGSTVYHWNWSSVPVPISRTPTSRTSSAPAGHAPDSRHTGSHPPPSGVGGRGDGPHAALHAALEKRVHIHQEEPHYAQHEKGEFDEDIMKQHPDDHSFVDIWDGDEHEDLHLSRGVPGLHTPLYRLPFVEGQHNETHVVGVHTSDLDIPKRLLVDGGQLHNLIGGDYDMLVTRDGRPKPLLVHGRLVWKKWAETYAAGISPDAMYLFYDHTHHTWVFNRELNFKKPAPVAFLPHGALLPVVRQLPHATSVGPAETPDAAKKLAEKRYTAYTKHGVPKGVHWVVREVPGGLGRGAAESGGPTVDAGIRVRGHPGHTAPEDFFGLSLQKVFHTPEEGPGDMDEEENVEDDEYLEDDESSDHHGIHGEYEDEDEEELEKMFVPEGTRTRQQYLTHPQTQVYHTFDDMHSKFDHERIVDDPIAYLEASGHPDVDTIEREVGDDTTAIPHPLRKLEE

SEQ ID NO: 744 - protein, 499 aa, Neospora caninum
MESEIGSGEAANPAASVLLAIVGFAARTTWVGGLILLCMVVLVWYFQEKLLFYPGVPQGFETPDKNPKGLRSPAERGLPFEELWLRTVDGVKLHCWLIKQKLPQVSAHAPTLIFFHGNAGNVGFRLPNVELLYKHVGVNVLIVSYRGYGFSEGSPTEAGVYRDAEAALDMLVERQEELQIDAKRIFLFGRSLGGAVAIDLAVQKPHQVRGVIVENTFTSLLDMVLIVFPLLRPFQRIVKVLQRLYMDNGEKVQRLRLPILFISGQKDELVPTRHMKRLFELCASPLKEKEDVPLGAHNDTWEWAIGGKSYYDRIAAFIQHALQFDYQPSRQQSDDARLQRRPSSPDAPAIPSPSKSGVPAQAEKEDMHGLPLSVTPMDAAVMPSSASDSLLPKGTAEEENPPSKNLSCSPTSLDLPTASVAAREVVAAAASAASSAAAKAASAFSPVAAGVPGSATGAERGGEGSETFGAVQRDGANGGLRHRAVGATCEGSECGKEDL

SEQ ID NO: 745 - protein, 1270 aa, Neospora caninum
MSNAQPSHATLRAQGLSSTAAAREQPRSSDHVRGPSPHATPAALDARKGEADWAVDSEVSEVVEKLGSVISASSENPLLKEVKDLLLRVSLGEKQKGAVREVDGTSCPAPDADASMADAAQKQRVLAYLQALLQIQLQLQRDQEEARQNHSTSAIQVQTKEDRVNSAADPSESPRTLLRRYKEDFKAMNESCQALKEERSTLKKWRDKVMEEYQELDGSLQFVLSEIEAIKAKHQADANINSILVHFIVTAVRLLVDASMHKRNVDNLLADLSRLFDAPNLSVRNPRLVVWCNRLRELAGAQTADGQKPWPEERGETQPPATVVALHLFDADKSRDPGEAETEEKAEASPKEDSPSSETAVQPWAPSTTDSAGSRGVPVLGQRAGTALSHRRRSDMPGRASQTTRLQLAPIPDRADSDGRLICNSGHGPALLGSARRRSATALGDGAFSLAAQFAVAARAPAPGVEHTPVLLPDVTGEEAKRDSPLAPADCSPAFLAAETAAAPGGLEVAENASAKESGGRTCACCGPSKRQASVEMVRGNAAQKCDAREKCLKKTGSRGKACPKQQKSVSGETWAGLAASGPAVRQRDSTASEGVMKVDRATQFDSDLQTRLEMLLESPQVRPSETKSGIEGFRGASGEGEVFRGPSSASCDLPTPFELSATASFAKELLQRANSFSLSISDVRKVLEEALGLGPDGLPGKDAPRLQPLQSRSSLYCLPPTPSPTRVGTCESTLSLLVARAGTGEKPASGAPEGRPTRAGDEASEAGRRLQEASGASIGDKDAAARVPAAPRVDRWVPCSSAGAPAWTEGFSVERSFEAKSASVSFEGGLLTPKPSRVEDAKSRGTHKADQDPQQDVVDLVAVYRAMLALEKSEAAKADANRSKDEAGTQEGGIQSDQLRQVIEVLWRQLSSPVAAVAEPKPEEKEDEGAESDASSSRAAPTLALESPVALVPVGEDETQPDRETARKSVDSVASALSEAASKTPQPLSMPAFVAAGSVGRPESAKGKFKLYTLPSLERRAIEARQAPSAFPQIVYASSIERRHSLLPGPVLTTVPCEPISSPYSLPSPAGSPAAAAPAYVLPQAVPSQVLAYPLANVPVSLLQAYYSAPPAGAVIYSPLPAGVPVAAGNPRTQRSAAPTEASAVASAPGREPERNACFALPVCFGGEKRETEETEEVPAGEALALGSEAETKRSAEKNHIPELHPHLHEHKEAERALPPLLGDSGEAPPTLRDSARVTEGGWCCQPRACGARVDAWGREGVEEKREIA

SEQ ID NO: 746 - protein, 504 aa, Neospora caninum
MSVVEEEMRGPIKVMDTYDPIFDSESEDEDCLYTVIDVAADEYRQALNKTSCFSGAAPPTKSHLSLDEFTKLAKEILDNYFVNRETFDLSKALEELNCSQYLDSFLVLAIQSSLHRSTDEQRCISASLTLLVDKHLISKQQMVRAFEKLIQSASSIDLDTQPNPDRVYLFLDCAVLDGCVDESYVRRLPEKFLDSLSPETLDASGHLVESLQNLKTFKEAVRNFLPDFFNSGSVEEMKFFLDEQNQPLLQHEFVKMVVEASFSKENEHREMVSNALDRLYGKLLKPDDIQLAFARLVGDVEDDSLDNPDVYYLLAKFLARAVADEILPPSFLVDRYRLNYGGDGGMQVLKQVQKWLVEQNGKGVSVRLRKVWTGTDPDNAEACEFKARVRECLYEYFDSNDKQEAARILRELELSPDQAAEMVRKLLVISMEKAAAGEPTTEHVFALLSYLLERTDIDEEMIQKGFEQTRNLTEEIKLDIPDMDRRFPQLVEEAKKRDMLPAGF

SEQ ID NO: 747 - protein, 275 aa, Neospora caninum
MRNCLGKQICRGPSRGVDLTYRDLLKLTVPFGWSIAACCLFAYYSIEPISNSRFPKTVPMYWSLISSFPAFMTALNTFIFYRDAVVRSGLSRVALAELTQVVRLISVVGVFTFITLAVASAVQLAQCRLCNNESYKENVMWCGIALLWMVVMACTTPTARHFSKLIFRYETFQQAGGMAPTVSCTTPEAPPSLRPVSWGAVGSHPGGPGVAVDGPYAVAASYPARAARTLGSSGGLAAEDDYIRAAAGASPGQIVTGKVSSKAESSKLEEGKGSS

SEQ ID NO: 748 - protein, 136 aa, Neospora caninum
MKVACRVVFCLVSLFFLSSLSSLPFSSLLLVEGASSQAPPATQKGNSSSPPRTAADDKATVHKVGRELDEEDETFLREEFMEYDTNGDGMLDAYEVRITHPEIGNQELFSFFRSVDANQDGLLTLREYREYVAASI

SEQ ID NO: 749 - protein, 583 aa, Neospora caninum
MVLAELGEQISGALRRLHTATVVDEQVVQECVMAVCRALLQADVHVRVVQQFKASVTAGINNRLLSHSQAASSSSSSSASSQKASSTAGKGSAAPSPATGSGGTGPAVKFDVATGATTEASGVGANKDTFQEINTRAAAVGVNSRKIIQKCVISEIVAMLTPARQPYVPRKGATNVIMFVGLQGSGKTTTCTKFAHYYQRKGWRVALVCADTFRAGAFDQLKQNATKVRIPFYGSYTEADPVKIAEEGVEQFRKEKYDMIIVDTSGRHKQEAALFDEMKQVAEAVDPDDVVFVMDSHIGQACFEQAQAFSESVDVGSVIITKLDGHAKGGGALSAVAATGAPIIFLGSGEHFDDFEAFEANSFVSRLLGLGDVGGLFSTLKEMVSVEKQQELMDRLSKGRFTLEDMGEQFRNVLKMGPISKVISMVPGIGSNLISKNQEQAGVMRIKRFLCIMDSMTDEELKCDKQFTDSRILRVAQGSGTSLEEVKILLDQHKQFSKMVGKMGKIGLTKESALQNMMRNPQQMMSKVQNMLDPRILKQMGGAGNMVNLLRELQSKEGMEDMQEMMKQMGMGGAFRGFGGGRR

SEQ ID NO: 750 - protein, 599 aa, Neospora caninum
MPAHRRPAMILRAMPGLSTRVSSRLLFLFSLSAFASLRCLHAPPASLCLPSSLLSPLAATPSPASCAAADSRPGAFVPSASAPQFFALALPVSSEETDVSEDRDDDDFRDEDGVGDDDAIRDDEIEEREEDLLLMQKAATAAGQSAQAKLAGGSEARNQSPGEVRGPGDSADPRLDRLLQLRREATDALQTRIGKVLENFEKVSFTDPGQIDGILFRETFQDDPLARGRWVPSADPKFQGRWAVETRSEAVIAGEKNLGMQDMNKFHGVATRLSSPVTDTLNSHFVFQYEILQTRPLTCGGGYVKLLDFPKDKALKDFNHLTDYVIMFGPDMCGSSNVVNFILKILNPATGGWTEHRLDAPPRLTPSPLSNLLTLWIKPDDTFEIHVDGSVVRQGSLWKDMLPPLQPPKTLVVGLRASAAEDEDAHAGDEAKKNSTSGIRNPAYFKLEHAHRLRNINAIGLELWTVEGGTAFDNVILANSIEAARTFAKTTFDVRRRKEQELRLQMDTVHRAWRLEFAEKQRALEAELESEKASSLPSSFLDGLLVTLQQFADATGLFSPFVLAALAACTLCLLLVIGRQRPRPSSPREPTEKEGKKKK

SEQ ID NO: 751 - protein, 805 aa, Neospora caninum
MNGPAPKLDLGPKRSLGATGFDEDPRGDSARRRTGFSGFSDAPETAKPSNFSSAPPEPTGFSDRAPNFSAYPRAAAEATGQVALPGALPVPLAAGFPGGEVPEGINPYTGAPYSQRYYKILEGRKKLPSWNAKKNFLKLVKRNRTVILVGETGSGKTTQMTQFLIEAGLHQGKCVACTQPRRVAAMSVAQRVADEMDVELGKEVGYTIRFEDKSSPMTILKYMTDGMLLREAMADPLLERYSVVVLDEAHERTLATDVLFGLLKEVCKNRPTLKMVVMSATLDARKFQQYFDDAPILNVPGRMHPVEIFYTPQPEKDYLEACIRTAIQIHISEPPGDMLIFLTGEEEIEQTKRELEKLAQRHSECGELMVVPLYSSLPPSMQQRIFEPAPGPKYEGGKPGRKCVVSTNIAETSITIDGIVYVIDPGFSKQKVYNPRARVESLLVSPISKASAQQRAGRAGRTRPGKCFRLYTEKAFEQELVDQTYPEILRSNLGSVVITLKKLGIDDLVHFDFMDPPAPETLMRALEQLNYLGALDDEGELSQEGESMAEFPLDPQLAKALVDSAKFECSKEMLSIAAMLSVPLTFLRPKERSREADAAKARFSHLDGDHLTLLNVFHAYVQHGGGSPDLERQFCFDNFLNPRSLASAKNVRTQLQRTMERLSIPLNSTPYTSKEYYTNIRKALVAGYFMQVAHLQRSGHYLTVKDNQTVALHPSTVLDHKPEWVIYHEYVLTSKNFIRTITQVRGDWLLEQAPHFYNPDDFPECDAKKVLKKMIERQKKEKEAKASANGSAAKDAKSTGAPAAA

SEQ ID NO: 752 - protein, 414 aa, Neospora caninum
MAALGFYGLAYISRLFSFASLEPGLADKLLRVFCPRSPSLLLFFSLTCFWFFVHAFVSPKLPAVLLPPSARRQHTEKTARLAKLERTCPKKSAKSPASKAARGPQGGASSGPRGVSGEAVSDEIAALRVYFISANANTTASLHALYLAPAALVHAVRSVILPASQVLIARAASQAYAEALARGTDAAARMQAEQAALQAAASQQDNIWSTYLAHWDAAPDFWDGAHDPLVVVSSYIMGSYFLWDCFECLRNVEIHQRAFLVHALLSLLAGTIQIAAPGIKLSGLCSLFAVSEISTPFLHFRWFLLQNGQAETPLFRFINALTVFLFISVRLVVVPFLVFWHYWIDCAVYRQHLIPQANISTLRMVFIMVLTLGWTLLNYFWGYLFFRSLCRKRKGGKKAAVADMQGPDEERKKE

SEQ ID NO: 753 - protein, 1107 aa, Neospora caninum
MDLCLAFFETFADDKVQGRRGYESRRRAARWRFSSALLPSSGFSFTENKEGAEGSEPVSEAKGSLEAARSSVAVFTDAGGSQAAEQPRASQNESGDAKSNSSKDDKLSSESDGSWNRRLPLGGIFHRMLSPMLPFVHKSVQPATRMTIMSPLNFLHSLWSPRISVITSVQDEDGDKEESSAHEAAATKQAAAPGATQDTASAAGEASRTTSTTTVSTSSAPASETSGASETPSAGSSEETAGEKARLEADNNLSPERGVAGTGQSGNTVRENRLADEKEKGEASQVEHQETKNENGEANGETDGTPEPSPPGQAANEEGTVPTPSAPQAEDTGTSPDSAESAKTEARGAEEKETKPSESPESAKNEARGAEEKETKPSESPESAKNEAGGAEEKAMKPSESPESAKNEAGGAEEKAMKPSGSAESAKNEAGGAEEKETKPSESPESAKNEARGAEGKETKPSESPESAKNEAGGAEEKETKPSESPESAKNEAGGAEDKAMKPSESAESAKTEAGGAEEKAMKPSESPESAKNEAGGAEETSMKPSGSAESAKNEAGGAEEKETKPSESPESAKNEARGAEGKETKPSESPESAKNEAGGAEEKETKPSESPEGAKNEAGGAEEKAMKPSESPESAKNEAGGAEEKAMKPSGSAESAKNEAGGAEEKETKPSESPESAKNEAGGAEETSMKPSGSAESAKNEAGGAEEKETKPSESPESAENEARGAEEKETKPSESPESAKNEARGAEEEETKPSESPENDRQAKPANDAEKKRGDEMNREETTPDDTSQNSVEEEAGGKRHGKPPKSGESALSGAASLQTEEPAVGPGGAVPGHAQASPKDEKASPPAAHTSTPAGAVGSSVLVGQNAPTENASAVVVFKFCRRGHGACAPEKEETLDKIQVYVDRNLKLDLRDHDDWTRIGAAMNNWLRDRYFHGPEGKDFGWGNALRGCILDWAEPHRKFSPTWIMMKEKEHKPTKTYREMFLDFYTPDPDTGHRVPSLVNCFHFLAGIDYFFVTSEKPSETKAREIAHEALVLRSSIDADYEAFLRERANSGMNLEPPPPPKRQAVSAQDPTRRHWSSLSLAFSMVQKKRRLAARSSELSNA

SEQ ID NO: 754 - protein, 939 aa, Neospora caninum
MGKAATAEAAPVGVSGSTTTTETEKQAEQNHMVLKPAKQPVEKHRLDYKPPEFFIDFVDLDFDLYEDKTKVTSILTIHRRPQTPPTDLVLDGEDLDLESVELDGAALSLRSAETQKANQKAVYSLDVDGRLVIPADLLPEDAEKKFKLKTVVYVNPKENLQLMGLYKSGALLVTQCEAEGFRRITYFLDRPDVMSLFKVRLAADEKTSPVLLSNGNLVQSGKVEGEEGRHFAVFEDPFHKPCYLFALVAGDLKSIGDTFTTMSGRKVQVSIFSEPEDSSKLTWALESVMKSMKWDEDRFGREYDLDVFNVVCAKDFNMGAMENKGLNIFNAALLLADPATTTDAEYQRILNVIGHEYFHNWTGNRVTCRDWFQLTLKEGLTVFRDQLFTADMCSAAVKRIEDVIFLRSRQFAEDSGPMAHPIRPETYIAMDNFYTATVYDKGAEVIRMYHTLLGEAGFRKGMDLYFSRHDGQAVTCDDFRAAMADANNKDLTQFERWYLQAGTPEVEVVEAAFQPETKKYKLTLKQHTPPTPGQKEKKPFHIPIKIGLIGKNSKTDLLKPATMVLELTEAEQAFEIAVSEDCVLSFLRDFSAPVKVVHRQTDEEIAFLMAHDSDDFSKWQAAHTLASRLLKQRAEQWRETQGENVSFEPLPQTYVEAFKQTLLDTGRDRSIQAYTLRLPDRDGVAQDMDPIDPEALKEATESVRREVGRLLKTELLNVYASLSAPETETQESRDQSEVARRRLRNVVLYFLTGEKDKQAAEIAMKHFKSAKGMTEKYAALSILSDIEGRERTAALEQFYNDAKGDALVLDKWFAVQALSDVPNVTATVKALQKHADFTAKNPNRLRALIFSFTRNPQFHNKDGAGYALLADSVLEVDRFNPQIAARGAGAFLQWKKYGKTRQGEMLKQLRRIARTPGLSPDTLEIVQKALAGAPAETTA

SEQ ID NO: 755 - protein, 783 aa, Neospora caninum
MPKHSSDPSSREALLPAPLPPPPASLSAFSSSGRFLATAVASSASPESADSQLPRSRVKVWDASSGGDFGTNAVSASESDGVSGLSFVSNYQPRFSVEWQRQFLGHSVTSLLFVSRASAGGQRMSERLLIGTDRGMLASADVTASSSKLLFSTYLGEASESSAGGSGAESSFDSTKGSSDFPIRALGCTAASGGNVVALVGGRDGSRLVTVDPEDGTVVRQDELSKPYNLFASPSSTDADEDVVLLAMRRGTTELGSSAGVVLYDVQHQRPRAKLVGGSGGAFAVALEKRARFAAGVFSGSGKDEQHAQLVVWQIPDRSADAAERAAAKGKSKKLQPACSGSHFEPLIQVVLPTNRDAANAEDASDSGDDEAAHPYSQQAIVTLSRSNAVIVWALGRDAGAEGQSFSLVKVAQIDSVSFPCISPKASLDSAPALAAAVATPGVWFMQELDESGRARDEDATSPSGSSTKKRRHSAGTEHPAQERQHLCIVRGCHTAPLFQCLLLPRFASRRSSAQELYLPLLPRYSGKFGLACVEAMKLSEVRAAGGDSRKAGEKTGSAAASAGDDGANRVSLPTASLKRTIAAVTESDGDDVDASGDSGAVEEGKKKKQSNAKGLGLAGAATGGAPGGEHSNVAVILRQALTASDARLLETVLTSTAKDKKEVAAGVGSLTPVQALRLLQHLVQQQQVNPAASITKGGWIEEIVKQHAVVLSQTDAGREQLVLLLLQVEERRRSESALVKVKGRLELLLQQMQRVQRLREERGKEEKEAREPLVVHKERANA

SEQ ID NO: 756 - protein, 617 aa, Neospora caninum
MGDDGFGPAEAPQDDVKDKEKLLPIEFLALTKDGAELYRYENDRSPEEIKKPLLTLEGVEQAAWTADGQKLVLVRKDAPNRVDVVALDGNKTVFSFTGASSVVKFGLSPRETFLFVCFRHEPAAHENFCLYRLADGEKVLSFTLKQINTNTWPPLRWTSQESYCCRMVTNEVHIFKDNVFNLNHPHDRIRCENVVSFSPCNEKKKPANSAPRAEEAAGTSSGKEKPASALTCAVFVAGRKGAPSAVKLFDLANGSSCLCTKSFFQGNEVAFKWSCDGRAVLALVHTDASEKSYYGSDALYFLKADGSYDSQLMPAEEGPIHDVQWSPSTLEFALCKGPMPPEASRPKRREKGEEREKRGRRILLYDGSKKPSAPKLSFGRRMQNTLRWDPFARLLFTAGFGNLAGDVDLWHKQQKKVIAKAQAPFTVTCDFTPDGLHYVAATTSPRLRVDNRVTIYSISGHAVCRLDFPVLYRVLVRPPSPSLAATLNQRQSHLLQAFMADSALFLSQHFSSLSLESAARSGGFADATQGAGATKSVSPTQPVSRGVYRPPGSTGALAARLRAERQATVNGGNAASAVWRAATATPAKSIPGLAQNFPPGYSPPGASAKASSGKRRK

SEQ ID NO: 757 - protein, 599 aa, Neospora caninum
MPSVGDAPEMPVPPGASASLGTSLPALSPLFSSPSELLYTFSPLVVLFVCFHAISSNSPSSPSLSISASIRAFRLHLAVVHRSLPSSFSLKDLVSPALLCLLLPYVSFLMLRVLPVCFLEQSIPPGAIAVTYKELFRSPAVFSVSPPSRGELETMRKKHVFLSLLPDTGALSPLIRFLLHPFYLSQSSVVFWLGVGPFLLYSCAQYIQRVTEEERGGMTLARHRAGPQYSSPRLRSAITILICVYMPAVFMTWLTTHVFPGAADGPPFRYLGVEGAIYALAAVVFFYDPVVHSGMFADPSIQFPVPLHVRNVTSVLVFFLFLFSPPPGDLLLLLSGALSAVLAITATSLPPFFGVSGAVAAISTVTSAVAFGAHLGVSHTVLSSLSSLFFIDYAPLQQEQQARFSSLQGTEDTRFSAAAAAEGPSEALTWTVAGLVLAFVGGMAVAGAIWSWACLVEGAVHAVRDLASVRARLTSAAVMVAFTYLPFSFSSLPSIGALLSDPLQTLLSLQFNEPSLYAVTCSERTVLLGSIGAKTAAFWTPFFGLGSRGHKLKYFIGPLLLFLLFVGMTSEHWRRIGPGFLGTVFSLYRLCSLPRQEGV

SEQ ID NO: 758 - protein, 314 aa, Neospora caninum
MRANYKANVVQFSQAKTADMEERMISRHGSRIRPLRIGLFQWNTELFKPNPLEIVLPFCRERPDGDGKPVIDPEEIDMFFVTTQENNRLSPAEEMTMRESVLNSLNTLSATPNWTSSGLLQLNNRKGTVIRKWKVFTPNTQMIMWFARDTVEFQQAPEVCMGSMKSEEKGFVGVKVTVAGVGKVLIGGLHIDSKRKKAGQLKNILDMMAANCGGEGNLDAFDLVVISGDFNSRLDAQTSNEVLTGVSAIPPFTSYLDSRGGFLSINRNDHEKVLQFVGTRKSLEYRISGSRRNSNKGRCCCIFYQVTYLLQHAQ

SEQ ID NO: 759 - protein, 371 aa, Neospora caninum
MMYPLIYYPILAAVAIGFVCRVLATEQVHAADAEIASAGIPVPAGSSAVDLRMEKQPSAAGKQADSALVASTRVPLEVDYEDATPPRGLARRTLRYRKPRVKTSNSRRRQLMRKIGMAVLAIVGAAMIVKAAYSRRQNKLRAHAFSYIYGRAGVAERAALGLEEQRREVRELLGRVRVAQRAAVSTDERQELTETRQALEKFDALLAMQARASQRELADFVTAIGILHPQVRHLPRSLWGTNAALQAFEAGRLDEGRRFWNRLHPHEEAVRSSALPGVVSLEQEIEEARRRDLPTLPSLYQQMEEARGRQVTSTLDEQITALNRQVPNFVGVDPDYAEQHLLHFTPSRSEPGYVRMAADVMRQAMQVKTGT

SEQ ID NO: 760 - protein, 141 aa, Neospora caninum
MAASTVPISQWPSLLYAPPTSPAKPAVEALAEMQLDDLHYPRQMLLCRGAGYSFAQCNRMAQPDARVTPENPAEQLMQEEAYAAISCLAQREGGKDEQCRYYIERMYKLANKEKPPESGMLSKAATLACKLLGVQQKKNDA

SEQ ID NO: 761 - protein, 142 aa, Neospora caninum
MASNLESIFKIFDSDGDGKLTCIEMHQALGASGCAPSVEEVQEAVKAKGSDFGDFALFKALYGACLETRISAAELVPLFGVVDPAKKGVVDARSLNYLLTNFNEKLTPAEADEFIQGMLGLPKEGTVPIPDVAQKLEQLQKI

SEQ ID NO: 762 - protein, 294 aa, Neospora caninum
MAAVRVFATGLVVFIVGGASALPSQPYTGGPSPPYPVGHSPGMPVPEIPPPPGFKPGVIPNPPYPTGHPPGMPVPEIPPPPGFMPEAIPNPPYPTGHPPGMPVPEIPPSPGFMPEAIPNPPYPTGHPPGMPVPEIPPPPGFKPGVIPNPPYPTGHPPGMPVPEIPPPPGFKPGVIPNPPYPTGHPPGMPVPEIPLYPPVHILPFTTTTTAAPSVLVYHLPVRYPPPAVVPVPVRVGGAEVDRQLRNAIKAHRHNRGSGSGSFFKAALLLVLAAASVRAINSGQRMTVSEANGDA

SEQ ID NO: 763 - protein, 736 aa, Neospora caninum
MEGMWSLRRRCAALLLFIGPLGFLGWTGVRADLPIHATVHDIKGDWTFYLTPAVSGDVSSCGSPSPNTNTANLRDELKDYKSFLATQGGIKTEVRVSLTDIPVSFATTRSAATLESPHRASWKTLGVFDGQDKQRLVGSWTTVYDEGFEVDIGGSTRLMGFMKYNPHSHCSVADGDLENSQGATACYATDPSRTQIGWYIQQQEGGSRVSGCFYAEKSGASSSTPAAFVAIREASSVERPSGPADGSELKDSTSYISQSFVDTHNASPASSWRAGVNSVFANVNRRDLSRFVKDFGFKKMRVAGDNAGVLSFMQSSTEISTAEGDAAASQVYACPCKRGEKSLDTRKLNQLEDTLEVLSPVSALEVGRTNFLAPIRSHVHQVASTTTGPEAQSKQLAPGATVANTQDPLTLPKEFSWSDPFSNKAFDEKVTNQGSCGSCYAVAATYALQKRFEIAASRMLGKEVRLFGTVKDDAVTDSEEVSFLNIGNTSELGELSSQSVLSCSFYNQGCDGGFPYLVGKHARDIGIPQVRCMEYHGNHSESCPFQTATGSPEAGSESMLQADANLGACAEHARWYAKDYGYIGGCYECNQCSGEQQIMLEIYKNGPVPVAFDAPPSLFSYSSGIYDANSSHARVCDNDSPHCSGVLTGWEYTNHAVTLVGWGETNAENEKPRKYWIVRNTWGPNWGVQGYLKIARGKNLGGIESQATFIDPDFTRGQGLRVAKAIDAMKRGSSLP

SEQ ID NO: 764 - protein, 244 aa, Neospora caninum
MSFSQAYGSGAYPPHGQGGASGLGQSSFAGPAASEPARPPSYKTVLLGDASVGKSSLVVRFVKNTFSDTMETTIGAAFFTQALQVDGRTVKFEIWDTAGQERFSSLAPMYYRGAAAAIVVYDQSNMASFDRAQVWVQQLQLSGNSNIVIALAANKMDLPHKQVDLNLGRQYAEENGLLFIETSAKTGQNVQQLFSMIARRLPEKPVSAQGLGGGVHTVKLTTDDPTLQTQGGGLASRFACCGGS

SEQ ID NO: 765 - protein, 959 aa, Neospora caninum
MFVSFLTFRLLHSLHDGADSVDLDSTDYEGVDDEGIRPSDGGYGNQMNNTTNSSLGSNAASSETALVPPQPTFPPLTFNDLAGLTEAKTELQEVVQFLRDPSKFERLGARLPKGVLLVGPPGTGKTALARAVATEAGVPYFYASGSEFVEIYVGQGARRVRGLFSYARNHSPCIIFLDELDAVGGRRQAAGGPGAGNREHDQTLNQLLVEMDGFNQAHRIVVLAATNRVDTLDPALLRPGRFDRIVHVSLPDVAARELILQKYLQRVPVEPESQEGAVSGFASLVGGGDERARAQNRAPASSASHSSSTSETRGEDEKERGSEGVPGRREADGKAGLGPEAYRQRPDPERGTEKPVFLDKTGAGDKDGKEDSEEPEKKRVLTQVHRDLAKQIAKITPGFSGAELENLVNEAALLAARADKDAVTLQELHEARDKVTMGPARKTRIMSPYQRQLTAYHEAGHAILAFYLQPYADPIHKATIVSRGSALGFVEQVPLEDRYGHGVAQLEARLCVCMGGRVAERLVFGRDALSNGASSDIETATRMAYVMVTEWGMSEKLGPLNYQVHGRSRRAFISSETANLVEEEVKQLVMTAERKAEKLLRKHRRQLREVALQLLEKETLSGEEISDILDPSGSYRSKVERLRTRMQQGEQPSLWQRLVVQLKRGFQWLFLPRDQTEFAAIGEADKELKAHEGTEKKQGESTSELEGKRDDGGNDDSGNGGTESREVPPSGEVDLHRNGDGNDEHGDKDHAFSSVKELSTKQSEISGAAENGHEDGSSDNSTYLRCPRGSVAEGQHCSSFSMQGNEQDSAFSGRENSHEEPESENVSRYAEVDILPSQPMMSRGAPSDAAASDEALPSEGDLGQEWTHTTPRSVQRHEAFVLENRNKGSSMLERKDSSIDRREHRVGEILSSAASQCSDSGAENCVNREAREHSRRTKRVQQWQLTPWGLGLSTVTREE

SEQ ID NO: 766 - protein, 499 aa, Neospora caninum
MERQRGVRRRSLADAFDEQAIGGGVARGGSDDFLCLLDTAETGQEAPYSVDQVTDDVREPLLSRQVEDSVKPAPAVVMIDEKLVDRRAKLAISRSGMKWSLFFYIILVFALAAAIFFELGHVSVLAAIAVGSAGVVLLLATLVAVCTRKKWAIIVAVVAACLACVTVLLACVHNVFVLVRSGTALRWSIGQGISEVYIVYQDTTTNITANIGNVQNQLNNTISNGGTIEDFISGRQPPGAPQSAKTGNERSAEEARNDGDSYDVANYQEGLVSVHGLAALEFAANEAVAARNRTADYPGSYPGYEGQLGSTGGATGFPGMITGVQIRPSANDWLTDYAVTGTPHLEIKNTCHNDYWDPTTSYRKGVNIASQSMARAGLFCAFSHFKIFEFQQWPVDCAKDCGFGDDPEKFIGSRGQANRYEAALAAQQGDQNGKSGFSDVKETVKVCAMLQTATACSIWNLGYFLILPVISAVWLLLCVCSCGAFVPSVYNGCRVIKNM

SEQ ID NO: 767 - protein, 2073 aa, Neospora caninum
MEEEEAPPEGRDVPCGGMGAEMAFVAAPVHASTPGGDGEDGDREEEEEREVEYGSGGLEGQSLGHEQEEDMIDEEDRVQTTFCAAPEDEEKLDFSVDEPRDDGKHHDAHPLSGEEEEEIVESAEDTAEDGEDHGSTSSGDAQQLSHAEEAASNQLGAEGRDDGAPSRGSKRNARSGAFSRSSAVSAERISAALTEIANLCGPDSDEEGEISEDEVPFCRVAPQNPSFRSRTLEFLNLPPNLTHVALQEALSRIGEVDEVVSSRFSSGPHHASPQEAGGQGDSSRRRASWIVRFRRPEDAAEVKKSFDGKVFGKCTVQVLFARDTPRNVQNRRDNNLLNPDGASGKRQLKGGANAGNVQNLRGRQSPPPPGAPGAGAGAQGPAGGAVGGCMPPGGPGAGGAPVGVGGLPAGPGVRSPLGPPPPFPPRPGGGQGPGGVVGPPLGGPLPPPLVGGPLGPPRAGFGGPMGLGGPPPPPPPPAPMMGRGGQSGPCCPPPPPPQQPGPGGVAEGRPGGGKAVLRPRPDAAAAKGREGDGVGAGQGADAKVRLTPREGPPGDQAGEETQGEAGRETGNAGGRRFFGGAGKVGVGGVTGPRERLTAEQRLERPVSLWKEKMTIEEQMNDYRELWKKFGYTNRYLLLSNIPQSLLSVEAMTAWLQTTTGESDFDLEFIPPLPSADAEKAGEEPHASAPSGCTREASEAGDEDGDPGHEDGDQGDRGEDRDEKATPQSDTEVSGAPEESAAHSQEVREDEGDERDECGEDGRTDDQAEGDEKYHGECDEDRGEGEEEKDGEEEKDGEEDQSGGEAASPARDIDERELSGDGESQEEGLAVPAEDAEDSGGLAGVASPDAGDEEERIPAVGLETGMEVEKREEDEVKKEVKVEEGEDSATNAFEALKAEKDEKLEETEVKMEVSSATSHGPETVAHITYRTKKACMAAQKKLEANVLGIDIEPAGPRKPNSVLWLGNVREFMCKKPEQDRLRSLFEHFGEVVRFRLLSEKTCGFVHYRRTQDAVKARNHLYGLLVGREIYLNVDFSPMDPNALHGATGDGSGAQAAPANRRNRHARSRSPSASSRFRTGSSRRQGAAGASGDSVSFPAPSGDPRHLNPAGQPLSGGMGQGGVHPPSPASGAGGPPGACRGPQFQGLRPMDGPPGPPGPSAGGPNGPSSIPPPPGCPWGGGGSGQSSKRSGANAGLQGVQSEGFPGNAPFPPSRHPLPPPPGSPYNMPGNAGPGLLAPGPGGGGMGRHNAGSALHFGSGWTQAEGPMASSHRRQEGKGVLSEGPGGGVSVGPGHRGGRRARGLSGFPGNLPGAGHVAPGEAGPEGLLGQMWREGEKGRGRERRRKGDRGPGEEDGSSSESEREDGDRSGGKRRRDSGDRGRKLRKDERRGERDKGEDSLLGLIRERLRERAAGAAGGGGFGRGHPDEEGGSSGTQPPSAGRKDGSSDPLMDLLRGDPSLLDSMILDLAKERLKAELFSKGDAASAAGPHAARASRDAGNKLGDPGMASPEKDGGWKGLAGKADDRERQALSLGPSDGGADGRRRSHERSDEDLRVAHRDGSNDERGKGRPHLEDPDDGRRGGARGRGCGVESRLGRTAGSYMNGESEEATSLHGRERRNSRDRGRDRDRGPGSSLDLPPYPGGNGGPDGEADRGRGRDKRGRSRYPRVGDTVSSRSRSRSRGSDMAERGYYPSNRFDEGLLGRGDMGGRRGGGAVDSRGGGDSVYHHSMQGRRLGPAADAGYGMMAGMPDLRMRSGGPGSSRGGLLLAERDRSPFGPNKRQRRFYDEYGYRGGDRNARGASPEPAAIMGRGRRSPPFYSGRAFGLDEPRGPGDHAVGASGSARGGSGDGRALGEDEREGPKGLMRMGGLSQGAAFEGDGQTPQVLPGGRGRRSFNDRQRDARRSRSRGSLDEGEAGERPNAGKASRGEPGGAEEEAGQLLMVCRVLKQGQRLCNMSAKFVRGDPNIRPPGVLDVNQRANLDRLQTHLRRGRHQSGAAPHGSGDGSIRYSIWQLGADTRQDSRQYDELCDYFINKERVGLLESPSQAIYMVPPNPKYIKPLDLPDANFMYAYVIAK

SEQ ID NO: 768 - protein, 51 aa, Neospora caninum
MGSIKGLSLKKHLGRKQKQNRPIPPWIRMRTGSKIRYNAKRRHWRRTKLGM

SEQ ID NO: 769 - protein, 137 aa, Neospora caninum
MSPPSASASSSGSSPHMDRLLGDLKLLAAYDSAAGWQEPKAMESAFQSLSWDDPDVLKALPQYLNCRGEQKRRVDFAYAALCPRPVDEKDPKQTLMSLWMKARLFSYDQKHPFVLSPFATADKSTASAGAVAADKPF

SEQ ID NO: 770 - protein, 201 aa, Neospora caninum
MAFTLPPLPYAYDALAPHISADTLQFHHGKHHAGYVAKLNGFIEGTAFAGKTLEEVVRSSTGAIFNNAAQVWNHTFYFNSMKPPTAGGGGKPTGRLLDEINKEFTSVEKFKEEFSKVAAGHFGSGWAWLVWDKQGKKVGIEQTHDACTPITEQMKVPLLCCDVWEHAYYLDRKNDRPAYIKAWWEVVNWDFASKNLEEALK

SEQ ID NO: 771 - protein, 252 aa, Neospora caninum
MAKAKYTLVLIRHGESTWNKENRFTGWTDVPLSPVGEQEAVEAAKALKAKGFEFDVAYTSVLQRAVVTCWTVLKGTDMCHIPVKSSWRLNERHYGALQGLNKAETAAKHGDEQVKIWRRSYDIPPPALEQSDSRWPGNDAVYKMVPKEALPLTECLKDTVERVLPFWFDHIAPSIMEGKRVLVAAHGNSLRGLVKHLDKMSDEAVLELNIPTGVPLVYELDEDLQPVRHYYLLDEAELKAKMEAVANQGKAK

SEQ ID NO: 772 - protein, 226 aa, Neospora caninum
MHRGIARCLFLFTLLGLLSFVPQAIAAGEALDEATEGAVETQRGAAEDDDTLVPADDEHEDEEHDDEDDHEADFESLIQMMGKDMNVNLPQNDMSKFAAVLKELTDHIDSAHKQHAEIAEKPHPFLKKIMSQRTHDKMVTTLQKIYTKVPRDEINDQLQAVMALLQHLKDDPHMSPKQLLEKTATHLGMPLTADMFEDMKKHMGWAEKFFGLFNPGELEEEKAEEL

SEQ ID NO: 773 - protein, 264 aa, Neospora caninum
MDYIKDFLHKTLSQYVEGVNEKTVTLGFNEGVEINNLTLRTDIVNHVLQNNGVDARLDYGRIGKLRLVYTALPGIVTMQVDGLDIRMRPNFTGTAIKKICATLGELQEDVDEGDVLGPVPSVSPYGIPCPPPVYPQCAFSPTQPEVHDTFSRRLPPHRVPRPPPVVRRARYVMPEAPMAQLVAVQDPAPSPRLPVALPTLPRCELQFPSFEVSALPPLCENVYGFIEGCSDTLAKITTPAHENFSDAPVSSYQCCVSLPRIGHR

SEQ ID NO: 774 - protein, 104 aa, Neospora caninum
MFGSSDSSGLSSGGASSSFSGQGAEGAVEAQQLVKLLLIQALNQQVHKTCFKKCFPSNKFYSELSKADHVCLAKCMDRMYEANEIVHQATVEMRQNFPPSGSGV

SEQ ID NO: 775 - protein, 91 aa, Neospora caninum
MSGAVMSNKKLQKIMTQPINLIFRFFTQRMRVQIWLYEQPDMRIEGRIMGFDEYMNMVLDDAEEVYLKKRTRIPVGRILLKGENVTLIMAT

SEQ ID NO: 776 - protein, 133 aa, Neospora caninum
MSAVVHKIFFPGVAPYLQAKALQLPLSDRMKKFISHPAGPFTIHFWAPALKWGICIANLADMKTKKVEQTSVAQQCAVALTGIIWARYSTVITPKNWSLFSVNVVMAITGSLQLYRVLMHHLAEKEAPAAPSC

SEQ ID NO: 777 - protein, 438 aa, Neospora caninum
MVSPGDIAACSTEQEWVQELTAALQSGALKIPALTAEVTEAAGGRQITPRGLDDLIEAAAAVRAGLPLPSHLIPPAEDEGGEESPVDQNLQQTKGSRKAEDSRSSNEGKRSVAAYADEARRLQANLDGVDEERKEFFLNAYRKELRHRGVDDRDCQTPQDLCNRLAFARVFNSSKNGRGATKPGREPSGTKTVRAEVTDGGRSRRSRRSRSRLIARLSGDDEADDNDEDDSSSGIVQISPGVFMARSGSLGGGTGSPFDRLFADVFGGSFFGGRPDGQDDESSEEEGGSPLQRARGGSLLDHLFGGDLFSSLLGGGLIGGGLREDDDDEGSAKARVKKLDFKTPESAEARLQSGVADGSQEDATSSEETDTRLLQLLNKAHARGDPSLALFIKKSFQDPSLREMLLTAQTEGVEAAEAKADGRGKYVLQRLKDNQLFG

SEQ ID NO: 778 - protein, 564 aa, Neospora caninum
MSRWGCSSLAGVTRSVLRPTHRRGFPSSGLLSLARPSRFVVSSSSPPSSSLSLPSSRSASLSAASGHRFRGLAHAATASTLSENSVRSEEPRTKESVDILALVKQLRARTGGVSIGECRQALEESNLDLDEAAVYLRKRGIARAAKTAARVAAEGLIAAVCLPVAHETGFLSGVAEGRETAREGGKTVCLLALNSETDFVAKNPRFIALARAAATAAAQAASRVSAEACEGQSTDAERRQETDESKGEKERTRSRAHASLLIEAAKASVVDPQKFEDAGLGGLFQQETGGRRGDEDARGASPAPGGRRENDYGDGISNTLGDMMILLSQQFGEKLQISGVEHVTVPPPCSPVSSPPRSCEVVGWYVHGQVAEGVGRAAAVVVLEWREREQIGDKSLAADRPPHAGRLEAFAKLLAMQAVATRPRFVKLSDVTQAEMETERQILRASVAQQFPANPEKVDMVVEGRLRAQLREQALVEQDFLLASQMSTGVLTEGPGDNVGSEAGGDLGDADSKGDSAGATTGARKEKKSENETVTVKEALRRVARVLQCADLDIKDMRLLCIGN

SEQ ID NO: 779 - protein, 420 aa, Neospora caninum
MAAPPQYGIHPYSHYGYAYGTGTTAVAAADYTWGANAAQYSQWQTPSAHQSAPNPLDQEPDALQSRTLFFGRLPEDVTEDTLRDVVAQHGDLKKVAVYPEKRMAFVEFYDLRHAEAARDALRGSDVLGKRVEVQFSAVKRPDKDGNTGTLYVRPVSTVHVSGSWTDPNSLDAYRELFAKHGDLKKVSANRKRETEKFVEYFDLRDAQKALDSLNGYVFNGATLHICFAQNASRTVNKNVERQGSRRTPESYGPVRGSGGSGSGGGMSRAYASAPYAAPVSSHHAVPAIYASGPLTPQHPPPAYVAAVPYAAGPAAYGAYAVPYQPAPAYSLYAYQQPQPQAANGYAAPQQWASTTAPVAAAPTPATAVPYAVAPQAASTSSTSRSSPASAPPSVAVSTSYAGTAPLPAAAGATPVAAPRW

SEQ ID NO: 780 - protein, 309 aa, Neospora caninum
MEESTQTSSPPPAAETLSLWLTVRLHPAAPLPSSPFSPSPPSASSSAPFFPARAVADLSECLDTPNFIPHITLLGGGLKHLCLDQITAIIKKAVGHEREGQDKTTTEERKTWKPFFVRVAEVTSGDLPFQCIYARIRKPGEPSPGPSPANPLSASAETEQPAERLLEDAPEELFALHAKLRAALYDAFDVPYRGDNDAYMPHVSLVYAETAQLSLEKRRFLARILNDTEEIKHAEDPSSTMCVSAAKGAQAAPAFLTQFEQARERFGKTIRGTFVSVESVEVVQTPLGKCSEAGRWRILASIPLRGNDA

SEQ ID NO: 781 - protein, 762 aa, Neospora caninum
MAGDAGKKKTGDPPSPEEVSNLFRSVDDLLQQESYEQALKVCGKIPLDEDSGRCRLFCLLQLGRWSAATDLVKTLMKMKAEEDGQEAAVRAYLFEEAYCLYRLNRPQKALDLLEKHGRVVDALPREERLRVTHLKAQTLHRLGSYDACRAIYEDLLQHDLDNPSPLPLSGPRFQEALLVNYLSSAVCSGELQAEGKPVVPAHLWRRVEANLNSTYELPFNAACVALHEGRLDDADSLLQQARTLCAEDCGVAEDDEDEAFSHGDLAGILVQQAYLLELQGHSEEASALYTRLLQRADHRGALDGHQAAAAERLAEEIDVAVLAVAQTNAFVKEARKRSTEAARERGSEDPSRLALPAGATLDDAIKRIAHGSGQALDQKLTKTQALTLAVNRCVAFILAGRLEEARRLLATSSTKFGTKQPKLLLLRAALQLASGHPAKAEEQLRQLLASSLPPAEAVRTHLALAALRLEQGDNAGASTVLAEAREVLQRVRGSSRDASPGSDLQLALLRDIVAMQQRAGDAAGAIQSLEAQQKAWRDGSTGEAATRFAVSVLLTSATACAALGQWDAAANKCREALQQAQPSSPEYLRALVGAVHAASHASEPRKQDAGKFLAELKQRLPQKILLLDSDEVERQDPSSFVGRKPPKEEERRGDGLATGAETGKKKKRAPRWPKGFNPNEPHLPPDPERWLPKCERTGYKKMLRRRKEAGRGGAQGSLVPGTAEATTGFRNVGPSTAKTEAAKDSGRNVGSRVVPGSGKDVS

SEQ ID NO: 782 - protein, 232 aa, Neospora caninum
MGNLALFMSIYAFSLIYRTEAFTIGPGSRFCARQSNVGGNVSQGCSVHAGRGVYTSSRLDPPSVTSLSSTWRGAKEISGLTESTAAPVFDVEKIRQILPHRFPFLLVDKVLEFEPGKRAVGVKQISANEDQFNGHFPNRAIMPGVLQVEALAQLAGIVALQPPISNGQGNFFFAGVDGVKWKKPVVPGDTVVMEVELTAWKEKFGIAKATGKAFVDGKPVIEVGEMTFALVR

SEQ ID NO: 783 - protein, 271 aa, Neospora caninum
MLLSTPAPLFARAAPTLRAFCRSVCFSPRCARLPLAVSFSAKGNVCFFPTGRSLHFSTAISPAASASQPPAPAAPCTVPKSREAECPAHRAETKTSGTSCDVAGDSPHLLRPFQTEAALQKRISGLQTELLGANWVDYLTGVLDSPFWEEELRVIEEEAQPFANSANVQASLQSLRRLFDLFYQLADIRDHLNQLMELGSRAAGIAGTGLNASEKVSNIDEHAKAASAEYDRLMKEYPEYCAKVDDVLGSGLALLRQKHRFTFSGLHRFFY

SEQ ID NO: 784 - protein, 447 aa, Neospora caninum
MTLPTQFPFLFFTATSLHESTRLLNGATAASAPLPRALMWRKRHASRRVVFGVAIALATVLLVSQEHPSVASSNLVPLITCAEADPKADAEPVKQGPAESNNERSRQTKRGNSRSSNKSQVGALWKRPPPMPESRVRRALGMFETVHSQMTLFFKGFSRSGSVIAYDLLDELRTVKEATHMMDVEFLVLDRVMDHYGSRSHLRVVDTKVMCKFLDLSNLWPWKIPGLLADIKKMVLEYRPVLAQFLGRYGELIEALILTSVPAGLHPFRSLIAALIGVPRKKLVFASSLQDLEKYIPREHIPREFWNPTGGPVREGWENKVSWRIMLEEVQLKLGADSVTPKGKQLLQSIKEEEAGYEKTADRGSGPAAQSAPPAEEAAGENEANEDFLGVAGTVNADVPVVSGNDMGDVSSAGTGQEPGDFTYPELAGLSEDDFAAFANEDFDDVD

SEQ ID NO: 785 - protein, 975 aa, Neospora caninum
MEALQNLPASLVATFQRGSPFPAPPSAPLSSPLSVLQRQDLLASADFSAQANRICGSAQALHAFVSSPRRAAVVSRAVRRWASPQQSCLPSRLASQSASPALCAAPLTDGSPARDAPADAAGHAAEAREIFPFQAEVKRVLDIIVNSLYTDRDVFLRELISNAADASDKKRMLMEKEGRKFRGSIRVRADREKNTLTIEDDGIGMSKAELINNLGTIAQSGTYRFLQQLKEQQAADSGASNQAASLIGQFGVGFYSAFLVADAVEVYSTAWQGGSEGDQAGKAREVWKWRSTCGQTFTLEQVDAEAERARWVAERRVLQEHWKKQKAEKTDQATAAAGEGVASPTGEENAETADEEEDPRDWSGTRVVLHLKEDSDDYLEDYKLKELMRKYSEFIQLPIHIWSERIEYERVPEGSEELHAPASAPAPDGQIPGLTRLTPENVDDQLGPVGDAASARRQTEPGYPSSGGTKFKTVTHRYYEWEHLNTQPPIWRRDERQLTDKDYVDFYKSTFKAYDDPLGFVHMKVEGQVEFNALLFIPGALPWELARNMFDEESRGIRLYVKRVFINDKFADAVPRWLTFIRGVVDSDELPLNVGREILQKSRMLQVINKRISAKAVEMMKNMKREGGDKWRRFWENYGKYVKVGAVEDKDNQEDLASLVQFYSTASPKETTDLAGYVERMKARNDKIDRGEDPLPTNSSGRVILRRKQNAIYYLAAENRKAAEESPALELPRELGYEVIFGTEPLDEFFLASLSINQFKGIQVIDVNKADLKLGGEEGGAGRLGNPPGAKGSGAGDSRPGLVDTESIETKRVQMGSLCEWLQQILGSRVHNVHVTDRLFTSPAVLVQGDFGLSPTMQRYMKQQAAAQGVSEQELYGASLNQPILELNPYHPIIQRLDIMVKRDVTDPRAKEVALQLFDVAALQGGYNIENPGYFAKRVIEMMKREADAALSEQKEQTPVPPSVPEQAQQPQSQG

SEQ ID NO: 786 - protein, 751 aa, Neospora caninum
MRFFTIGSFIGCVTLSSLAVSGSYYDSSYRQGRHSPSDGDDAAASQRHVRPGRYPAETIPQQYPQMMYLIDQDTQRDRNTRGLDSHRRGDLGADFASGYPSYHPSAGSPSADPAVGYPYLLVSPSYGQVSGAYRAGTGRVGYPYGDKGMSAHGGFTSMVYSGSERDAQWMTTAVGKAMRSIRQKLSNMAKGLSARMTDTDDPLELVQAELARLVKAINRLSAFCATGLSGSLTHSNVFGWGTAEAIDPKISEKQAAKVVSVARSVLQDAAALVDLLFVSPAEHTLKDGARNFQEKLSLLRDASSEFRAHLQALRGATRSKMADCTPLNQSPRTRDLIQSLWKRSTARANSVVKYVLNAMERLVPVVTSTHVAVLQGIVPESRTDFRLTDKTLSISELLDTIQSRAVSTRAYNDKLVAAVNQLTSPGTSGTASPLHPNALGRNVGLVPGSGYVPGTASLGGYFGGSSVPGIFPGTVRYGSTADLGLGMAAGGLGLGGTASTGLGLGGTASRGLGLGGTASRGLGLGGSASRGLGRGGTAAGGLGRGGPAALGGTSAGGLRGLGATGSLPAAEPRGSSAGGLLPRSPAPAGGLSSQGMAVSFPSDTPLQPVATPSTHLPSDGGLSTRATAVSSPVDETQTMGPSFPPEGPTIEQPSPFGGLPSGAVQQSDAAVPDVVPAPAVSPPAEPGTAEPVLAESHGVNDNQRDNERVLGGEAPEAGIGNDHGDGVGETDINENSDNVVDEEADREDDLD

SEQ ID NO: 787 - protein, 389 aa, Neospora caninum
MARVVGTWLDKHEDDIKKGKKKLLFLMRHAESEFNERRRDSFRRLRVRDMFSYDPNMQDVCLTDRGLQQCASAARFYSQFRAELPTVEVDAYIVSPLSRTIQTALNTFSCPAVSRDPEHRLSPRPREGELPENQAVEPLHTHEKWLLLPLVRERTDTTGDTGRKAEELRDHLEALRASRRLPPNCSIDEDLDWSLVNPLNKWWLQFADDEIAQIEEVLSAPWYDADARKHHHLNGEEHAQETLRPSGSSHGPASSVAGEQAAAQQLNKLESDGEETPLETEPESVRDQLKAALRDYSTDVHDLIREQAWAERLQASWRFRKVPLESSRAVRARMRLVLKAICSVKDARVVVIVGHSIAFRVLTSTPKMGNASMAPFALDCESKTITDLH

SEQ ID NO: 788 - protein, 914 aa, Neospora caninum
MGNADSKTRGDFQLFNLLQIANKGDADDNTEDGTQATQHPRRLRAFLEANLTAQELEAGLGSREEILHTARQYPDAVAKLLTQLVDVCTATADAVSQQPATLRDSSTLLTTVRLLSRMVPVLLEDPSLEQRIFWFAHFTPLSPGGNSDTRSRCPSPAGDTQLTGEAIEAPKDAARAPSDLAAHAEREEDSEGEDRAAEKREHGERDAEGDRKDERKETVSPASTASQTSSTGLPVLLGNEIVNLLFRLLFLRGFTAIVPGAPLSQEALRALPKHKVDLRFLWKGGVGAAPDFAIRPSGWISNNRTEVMNCLTACFSGPLYNAVDEYQLRVPTWIRVATAGNAPYTANLFCSLLSVVCSTDTTHRGVFGIFGNAETQAMVAASLQLLIVLLDFNVGVFVLPEGTEETETTKGDKVGRKTPPSLRNVFRSMLAGIHRTDEFDFIYDGLTHHLGNAAYRPHSAAISEKPDLFCEQLLILTWHLFTLNGNFLRHVCSRRGADALLRPLVALLLDASFFIHRRAASGPAADRDTLSPSTNGDTNRVKETGLTTESAMPANPAEAATALSRMGLLHMCSFILLVLSSERDFAVRLNEAFVGKAPADLPVFQGTYADFLCLAIHRVVMDATGPRGSSDSLVDMLLTVLCNVSAYVKAFCLESCLRLMAMMERLTRRYWLFSAPQHYHDVFFLLDVFNNLIQYQFEGNSQLVYAILRQKKIFCDLETLTLPASMRSSRRAGTKDGEEAVAETPESGDRSRVSKIDSCGGSERDEADCSERNGEKPEGEDAGGRDEGAGEAREDESLAGEDDRWEPTEEWLEEWKQKLPLQTILRLIQCLLPQVEEECARREVTDQQDILAFLEKTTMVGLLPVPHPIIIRNYQPNAYTALWFTSFMWGVLLVSSPALSNVTRSRIRLIVMNP

SEQ ID NO: 789 - protein, 1054 aa, Neospora caninum
MSSRASGRDQSSLRRTEEESEADAAEGERGVVLSEVEEDDDQGRLRGGVLDENVDYFQGSRELDLEERRAEEEAEKIIDEENTEDLVFGMRDDEREREAFLAAGMDADAFDASLIDDEDLDDLDPHLEEKARRAAERHLDARENEARRKKRGDKAAKGDIWAQLLEEDDEGASEMDRVLRRVEERRRRFFSGTGMGGRSGEQINLHDLNEAKKLLTESNPALVPFGEQHQQAMDTLFKYFLYKFNLHAFRRVQHGGGVGEEEEGEKRDEKALYYLDKIQDMIREDRSTILVDTRHLIFFSDQLVKWIEAYPLPALQVMNDVVTVEAEASCPSLYSTRICSVILTDWPYKEELRQLRCTHLNSLISVSGVITRRSSVLPKMRLLYLKCGNCLNSITDVPIQIVEGRKNDAMPRKCPHCQGSRFIIDRVKTAFVDFQRLTLQESPGKVPPGRPPRQREVIITGELVDSIKPGEEVDVLGIYQTKCDYSLNAKTGFPILATEILANNVVRTSDARMTEFTEDDLKAIKQLSRDPHIRERILASIAPALWGNREVKTAIAYALFGGVPKGRGPSEKGQDGNDVAASLMGNSRGRGLLGWGKSGNDAADPDAMGGRAEEGSSQGGGTLGATPHTIRGDINVLLLGDPGLGKSQALQYVARTFPRTVCTTGKGASAVGLTAGVRKDPQTGEWTLEGGALVLADEGICLIDEFDKMVDRDRVSIHEAMEQQSISISKAGIVTTLRARCSVIAAANPKFGRYIPSYTFKENVDLSDPILSRFDIIAVLRDVPDADEDHYLAEYVLTHHQLAHPNISHLENYQQRMEELEHIMLGNQAYEPIPQDLLQKYILYARANCRPVLDTSVNSVAAKVSSFYARLRRRAAATGGLPLTLRHVEALLRMAEANAKMRLSPVVSSTDVDYAIATLLDSFISSQKFAVQQRLGREFARYRALARGGWATLSALLRRLMQQRLQRAMLQRAGAPGAEMEPLSQADFDSARRVKVTEFVKVAAQNKFAAYQVEAWMASSHFTEQFRIVQEGEDKTIVSLNWSRPTASAADGSK

SEQ ID NO: 790 - protein, 757 aa, Neospora caninum
MMESLVSLEKAKLRLRLTVLSAFLFWAILGIAAWWHVTSITRSPIPALSSFPIAERVSSQLAEGQGGGAAARKAATAAYARWEAAHTKKGLDGNDASSVPFFALLPPLVTGFSLKLVPLCEQALPDATSFFDWLRAKAAALRDSGRVSLPEEPRVYRSLFPGSVESEDSKEGEAKQRPAFVTDLNLLLSPAEPAASGGPGTSTSLLRVVLTDPLPGASCAAPLPNLDRAEFDLTYTVAFSSSARDAKQTDAPADAAEAFASHFVLHADSAITVAAGASDSAALSSFRRKAASSFPALAQLLRLAFFAPLDETSFRFPFFSQQDVYNPFLEPFFSRLGFVFNFLHVQSQVVPHSGIASLLKRPATPSSAWLLDLASQHRLHAVASNWQPEQIITTPTHAPAPTINFAVYRSPVPLVLKDGKPQRHVEADAGEQDRSGARTETVNGIAIPGWGGLVIASPSSAAVPASSVTRFPSDEMRQICGVWVAQLRSFFSLPDTLEDYFGEAAAPRTERAEDRWRVQVVTSRAAKQAILERAPDLENRGTSAADVVMIWTHGEKGETRSDPEKEEKILVVAQHADAGVGLWEVWRLARRVYVQLVERAVSNIRSLQTILEDQTELVVYPHVGEALQRALTFIDCSAEALQGRICSQLPADVREQLLGTQMPFMEGKQDAKGSQRGALRVPHARFLGLALALARAAFQDSLEALQEESVTGKSHFSFEFKCAIYLPVVLPFFLPLLVGFIKVFKQRRLLEKAAAAL

SEQ ID NO: 791 - protein, 1186 aa, Neospora caninum
MAAGNAPDSVPSGGDARPSSSPSSGIQASILPPFASEASSFLPAMTYSDMASSPLLYVSCISSFFLAHALLVCLLRLSRAKSPLLATCAFPRHGVNRIISTLHACVVINWALLILLEDSTAHRPSLPVPPSSSASARCLFHFGRPVTDYERPMLLFSLSYFLYDTLYELASWDLSSVLHHVTSLVGLVNVLVVDRAGTDLVTALLVAEVSTPALHLRYFLVQYAKRAEALAKTYSVGEPDAETTPREQTKHGDAATERSCRHRGAETATETTGESETGRRGPERAANESAKGTDGSRVAPGLPGQETGSRPGNDCVPVDKTSPQAVAQALGKHDFRGPLDAVERAFFIIFLFGRGVAAPCLVYACVTCGSTPVLVRIGSVGILVVSVFWMILLFRGLLKRLNKAAGASAGVAPWKPEPRKREYSCNLYARDSAQKTHFRCRRQLRWQETLSGGIKIVAHKNPNRGEAPRSAARQGATGQSKDERPLNFVCMVNKSSKSAQKSLPNRRIGSVHADGAPAAFLGVGMLRSLSVPFESEHTSGTTKISETWVLTMAGRVVEPSVLSRTRLMRVSSASSCRMPAASTVLSTPRLSSGLAPFCSFRPPSRASVACPLLAIVCLGLSVLDLRVPSSSPCVCFGNAAEPAVSVPVSTSSLQRREELLLRAQASPSFVVSLDGEAYNSLLLASLPTVPTDGGWRRRRAVRAASLFRRQTPHRPYHLFVLYSLVGDAERHARCNECKDALDAFTRISEAYWAAGASMSPRAQKGTRAAFLPPAVAPVVFAVVDVARLNQTPALHALPSLPAVAHIPPSLLPGEEEEEEGEDDEDEFNPEDQWAKMIANAPLPFPRDEVLVLQRAINDAGVKKSMLEWVNMKAERNVTIPTTIWMDPRSLCVILAFLCFLLFLARRLLQLLPKQPWLLSGGACFVYWLSTSGLVFSIHNRVPLFAVHPETQQKVFVVPNSRGQYFLEGFVMSACATACGLAAAFLVFLPSAFLPSREELDEETCAPDYQTRKERGMQSALTCPPRLCPRDERQGVNEKGIHFGELEVRENNGRGEFACALLRGASCAGERSSDGGRSCARKGKGTAASGREAQGSEGDRRGAEDQAILQWIQAEESAKCKQGEGPNLWAVRVCMLVCLFMAAFAFVGSASLVFQVYRQKAPWYAVAFYPPPEYKRGPMRVDRGNEL

SEQ ID NO: 792 - protein, 1130 aa, Neospora caninum
MSDAEDRQASREASEAEDAEENEEEEPFSGSESSSEEEEEDRKRSKKSKKNSKRKSSTEKRSRSRDGGRRKKRRGVNAFLDVEAQEGDDEEEEEGDDLFDYSDEAAQAARLAAQASERRVGHDRTQQRRGGASHLESAIDSLTRRYQDQTFEEGEEEDDLDADGYALEDPNENNLLPDITDPKLWMVKLNKTGVEREVCISILNKSFQMQEKGSDCEIYSCYASDDLKGYVYVEAFSQYAIKEALQGLRLIRTYGEIKMVPLEEMTAVFNSVRSRAPYIPQRNDFVRVKRGLYANDIAQIHQVEEQGIVVTVRLIPRLDLNALLDRDKRGDFSRKSDMAALKRMGGVRAQKRFFDRDEVDARGGQVEQGVLPGTVRFAGMTFEESGYLLRRMAVRHLLVGSAAAPSLAEVTEFVQGQQGKEEEDLHEIRRPLSSFLKRQRSAYRLGERVRVIGGELQGMRGKIGERRQEPEDDDEEEAVEVILEDKKLGPVMLKTSHVVKDLQLGENVRAVGGVNAGHSGLITSVDFSKQTATVFSPAAGLEFTCGLESLTAAPDAGLGEEGLSSVRGFHLGDFVELTGGEKGVLVFIDKNQSSIRLLLPSNSALAATAAQLASKRSTDLLTTLDESRATIEKGASVIITKTQGVLPSLSGVPAGSFVGTTLGNLLGIPTTAVGGGLLGAQGPQGPGGAGTAGLGLKGAHAKVLHVWKDRLFLKVVGRSENGGIIAVDAKHVRVSGSPDFRGPGFPQDAFARNAQGSQLARAQRGRVALRGGLGGWGPGASRGGRGGFRRNPYLGKLVKIMKGRYRGLMATVRRVEQTELHVLLQMKEQELKIPKSDVQLIESSREYQSFVGRMAAPPPSTLGATSSLDSLRTPQPGGSAGTTPLDSSLLNSVSSPYLCGADGASSLSGSGPHSRTLTPLSSSSAFIPPSLASIGFGNGDKGACVFDASGRGDSVRRGSVASSFRLDDVDSDVDGPLLTPREEDAASNSSMSMSLTTASVAGGPATKPPDWCCPGVEVCVIAGTGGYRGKIGAIGQILPQDDHLLCHVYIGEEDLIAIAAESLAPVVPTQPDPNKRVMILDRECSEFGRTGIWVQAISPTCAVIRTLNAGEVMCDPRRLVNYSPPPEDDE

SEQ ID NO: 793 - protein, 3393 aa, Neospora caninum
MAPSCDDPEAPRASDDQAETSRLSPSRLSPRPASLPEASPRPAAPARPSKRSRVPPLAPVDAAPPCFASLSSFEADASQTPLAYCSLAALRRRHSPTLPPPALSLFSASFVAHNPLRCIYSELHTLLTVIRVASAASGLSASHPSAALGSAFGDALALPPPLSGFVESVESLLATLHRQIQLQHWQGADWGRRRPCRHSSGARGDRADEQARSEERRETRGPSCSSSNGQGKSCAAPGGVGRPSELDPFSPRSPFSPSFSAPLSPLAFAPPRPRWARVDGAHLAPFLFVVADLWPLVQQTASGQGPRAQSLANVFSVRPVVAGALASLTKFVAYDFLAPEHCVDAALLANQVVQAVLACAHQQLQQLANLALSPRTFVFSPPLQGYYGLGSGLAGASGGEEEVVLYRAISLLLDVVRSSAGPLVADDGVWEVLKLCYFVVHQPKISGVLRSHTEAALSELVVALFAPRRQTLAVALAETQARASGGATNSGDAELSGSGGTSAGETGGERPREKAAETEKKSQDAQGGRTDTPEKALSAVPREGSATPTAPSLGPSLGAGSYRPHGLGGLYMTLRFIAFLVAHGLPFSSSSSRAPPSLRGLPLGGEPKGAPAPSPDAAPSRAVPSPSVSANAAQGPPSDAAAPSACPPCASETELVAGALSPGDCARLDGAACAVEPSSSLRKMEADLLTLYDFSQKGKGDEDFYLEMRALGLTLLNCVLEAAGRGIARSPALRHVVSEEIAWAIVGGASTPLLGALGSRDSSLLMVSVQLRALWNLRTFRFPLPATEATLLQTVLLRVLASPLHLMLYQPPPHALGPPGTSAAGVQAQYQSVCQHLQQQVATHDFRFVTLEALVELCALPDFLPQLFVHFDCNVRAPADICAQIVALLVFLLLSPSAPPLPSLQRLQQFCQAVSGKKREEFGQLAGPLAAGDENLAALNAANARLLPPYRGVYRDATYVSIPQDAEGQCSPLPVAPDSRVPFKATRATHGHPDRERNGSEETDAHGARIFFKRRNFYGLALAKRRQAASGEASGGALFDFSRPRSVTELNRLALRGVLEVLALMAARVERQRARCAAAHSEKPERRAAAQRGNVNGEAEGTGRHAQEDSGEEKEEEEREEKEEEEEEREEREQEARSAAAETLAQAIIASGKTSAATAFALVQPLSRLRERRERKRRIEAAAALFNANPKTFIPHLEDLELLPSPATPRAVAAFLRDTRGLDLVKVGEYLAQNKDWNKQVLVEFLATFAFASVSLVEALRTLLASFRLPGESQQIERIMEAFAGEYFQQQPFVTTPLLPAQLAELAQVPAVSSGEEKTEQSGGAKRGKKEKEKEDPRFGIPRWVISEAAFWRLEDDSACVEAKTAEVLERPRRRSLDLSNLHVSEGHETEQTPDGEPRTHAEIREHLTNKLKTFTPDHPPPGYVSFEHRDTVFVLSYSIVMLNTDLHNSQVKVKMNVEQFLRNNRGINQGKSLPVFFLTEIYLSIRDDEIRMKSPAGSGQTCAVPPQEPLALAARAPGRRKAGVGSCRSGIVRGREHRASHASSLLHFLHKRERRERRRSSLSTLSARSSLAGTKCGGCAPRDGDAGAPGTHAESRREAPAGEGRGRDETQLLKSPASSLQSPSLASGAESCGLGDETPFAVLTAELDALFFFTFWEQGVFDALRGVLESTADLAVMEEALSGILLLAKAAVALGLAQAVNVIVAELCAYVDLSLGVLAQAVIPVLFEILRPERPTEETGLEGRAREGLGFAAGGAVAGGLGGCVYLREEGWAAFLEVLLKFFALDLLPPALANLHDFPDPSGRPLPRLCTLLPPAFAPPAQSRKKAGRRGWLGDLTNLLFAFADTDEDSEGDADGDELQGRAASLTAQQQEQIVANAVLAHDGAFFPSLFDKLYLLRCGTSFAFLPTTLSPSLLPGPSLSSAARLSPDRKRRGAERKGGDGLVDARSGDTWQPQRGEETARKSSREEGANKREEREKQLAAVAPFFRFKAVLERFFKVDELLAHREDPLTIHLPCLALLRSLRERVAVAEQPEPSEGIFTSLPPAAALPLASILVLHTLPLASPPPPLPGSDPSLSQDSSQNSEDPSVAALSVDPRVTPYYPYPRLSAFPPAVPASLVRPAPALPPGSAVSGASGVRGGASPRAGGPAGPAGLSSGVAEQVPAVGRLANLPELLNASTKPAGWRGQESEGDEETREAEFGALCASSMADDVRRFRAVGDRAFALEILGFLVADQGLLLVDLDQETTPTAEREAQASRRPAEKETEQADEKDRSLASGEKRGEAETGGETEDRKRCADEDVAHDAFLERMSKQELVWVFLTTHLNVLIRRYVIAAAAETVQPPLVAVERAVCLGRGRAGSRERTQSDADEGPLERQQVACVHQMLASWGRQLTVETPACLDRDELLFIERLMVTALRLVVEFLPIGASLRDLPTARDVSEPVEAWIEPSVLHLLALIVHLHPNVYMLQTERISAALQLLFRPPASLAALRSPLAIDVFLGILQRMVPLPPFLPPSALPASLLRQQQQQLAAAGAHFLAQWLLGEQSGEALLEVARPLHFQGCVQTLLALSVHTPQLLLLKGSPGGVPRVLERSEDASPGKDKRPVANVERSLLGLRRTFGRQFGAQGADWSGDRGDVDQTGDQTSVFSANLKALKMLNDLPGAIAAAAEQRDTSVAWLTVEEVGVMWVKVLQALAICCAFGPKPVRVKALGHLQHQLLRASPPPSSLETANSPVSPTASRPPSLLQRVMKSPAVWRLVLQEVLFPLLTYGFQYPCDCPLPAETRLEAAAGLVPSGETEPSPVPRASLGAGVGGDRKGTETAETPDQKPVVESPYTFPSESRARRPAAWMAAPLGRRYTLEAAVAALGAEEVLQRRAASASLVCRLFLSHLDFLLQPLGPAETPSDASNRFRGQEGEEEERECALRLLGLVGDQVLVGHFGGDAEAAHAAATAGGLRLLLPPLVQFLELLVEQACAAPLVFCDAFLENLKNTLLVVLTSPAVASASTEGTVDLPPPTAADFDIPGEKREAEEAETEKDGERKTGREERAGNREGGEDEQEGLPRKRVGADGRYQRGSPSAAYFDAALQQLSKSQQLLIVIAHQIISPSFPYLVKDLLTIILPTLLPPRFSTPASASASFQTAEEHGASEPALGENETRVGAGPGNSGAQGGPGDGEAGENGVSAESGELEETRIVERSEETRMEHPSRPPAPPPPPPPPPSGPPPGAQDLGANAGGESVSGATAGDETENPEERRQEDERSLQHADVEGGSSAFEGERAADGEDGSETEGSQGLRTGDTEGPQPHEIPEDEREERRATHEDTDKEVLVTSQCIPREDNRESKSAPRPRTWRETFFGAGAAAAAAALGREVYWTDQALPPDRGQNAQVRGGPGA

SEQ ID NO: 794 - protein, 105 aa, Neospora caninum
MKLPPGGLVLGARNFSSVKFMDQKRSGEETVYFKKEDEALLRNLLANHPEYDPKYSVDHMSSELGAIARDITLACQKHGMKDPSAAFMKDLISIFSTHGYAKVSK

SEQ ID NO: 795 - protein, 68 aa, Neospora caninum
MAGQNRKYAGKISQFDKNITRRGNVPESRIRSQNSYPVGPLILALFLFVVVGSAILQIIFSAQRGAIW

SEQ ID NO: 796 - protein, 161 aa, Neospora caninum
MPKNKGKGGKNRRRGKNDNEGEKRELQYKEDGQEYGQVLRMLGNGRLEAYCFDGVKRLCHIRGKMRKRVWVNSGDIVLVSLRDFQNDKGDVIAKYNPDEARLLKQYGELPANAKINESDVFGDEDGGGGGIDFQDDSDVSDESSDEEDGKNKDKDMDIDDI

SEQ ID NO: 797 - protein, 170 aa, Neospora caninum
MFWSAFLQCDPNSTFFGFMGITAAMVFSNLGAAYGTAKSGVGISSMGVMRPDLVMRSIIPVVMAGILGIYGLIISIVINGSMDTPDTYSSYAGYGHLAAGLTVGLSAMAAGLAIGIVGDAGVRANAQQPKLFVGMMLILIFAEALGLYGLIIGLVVATKKVEGLCTSYKA

SEQ ID NO: 798 - protein, 84 aa, Neospora caninum
MSTSPGLAFANLTLLLDVPQLPAIWAVNAWRELNGLVTEMKTLTGTTSDLLYPSNRYNPQNEKTNRMGRPRKYNHDSWMFGTPY

SEQ ID NO: 799 - protein, 122 aa, Neospora caninum
MASSRLCQCLAARGHSGLLSLSAPRLGAPKFERKMLGSYPVAPEFEMVWRDRLTAHGGYIQQTISPYQLKFIYPFWHTFAARCWSKCSAYAWPWLWPGLITFGLIKKMNHDVEEDIRDHYWY

SEQ ID NO: 800 - protein, 121 aa, Neospora caninum
MKLVRFLMRLANETLVIELKNGTVIHGTVVGVDISMNTHLKNVKMTLKHGNPTSLEHLTIRGNNIRYFILPDSLPLDTLLIDDTPLQRPAREAGRPIQRMRGRGRGRGGSAFRPRGGPLRR

SEQ ID NO: 801 - protein, 187 aa, Neospora caninum
MATESSDARVLAGQEQAVAAEVPAVPAAQEGSSAEAPQTESHLAPEQQVQETVMQAGSPYRVVGSGELSDPTAIQVAAIKQQQAMYTGFGAPYALNSPSAMAATPGMVPRMGHPPPLYLYPGAQAAVPLTTSFYNGPSSISGPCYYDPYGMLNPAACFTPMALAPTDPAASAKSLSQKNSKSRGFCC

SEQ ID NO: 802 - protein, 112 aa, Neospora caninum
MAMTLTSEAQVAEWSDGLIQQHKVVVFSKSHCPYCRRAIEVLQSVKAKDVHVEQIEDSPYMDAIQDYMKQKTGARSVPRVFIGGEFLGGGDDTARAKADGTLVEKLRAAGAL

SEQ ID NO: 803 - protein, 236 aa, Neospora caninum
MAGDGEYSFSLTTFSPSGKLVQIEYALNRVQQGAPALGIKAKNGVVIAAEKKLTTPLIEEASVRKVEHFTPNIGCVCAGMPADFRVVMKKGRKEAAAYNLFYKTPISVSQLVQDVAAVMQEYTQSGGVRPFGLSLLVAGYDEYGPQLYQVDPSGAYFGWKASAIGRDMQNAKTFLEKRYNPDIELEDAIHTAILTLKEGFEGAMNEHNIEIGVVGEDRKFRILTPAEIKDYLGEVE

SEQ ID NO: 804 - protein, 127 aa, Neospora caninum
MAPVLGRVQGTDLKVAVIGDEDTVAGFLMAGIGMRDGLGRTNFFVVDSKTKRQDIEEAFRTMTERQDIGILLINQHVADDIRYMVDLHTKIIPTILEIPSKDKPYDPSKDSVMQRIKFFFGGELPTS

SEQ ID NO: 805 - protein, 137 aa, Neospora caninum
MSSDADIQVAFQDCADGSKLPAAKLGVAARLAGASPSNGEVAEAAGKMSGGVDLAAFKTFCNNTQHKDDDLNDLKELFKAADIGGSGKIGKTAMKNMVQGYGEPLSDAEFEAAVKDFLRDNGENVDYATMLATILQS

SEQ ID NO: 806 - protein, 84 aa, Neospora caninum
MVNLNKLPAFLTDPNHPIGSLLLGLREFFFDSVRLVRRCTKPDAREFRKIAYACAIGFLLMGFIGYFIKLIFIPINNILVGPPA

SEQ ID NO: 807 - protein, 151 aa, Neospora caninum
MGFASKSVSPVEALGPPNTGAAPVESSPATDGAEKSSEQGSKEAETSSEQDSKGAETSSEQDSKGAETSSEQDSKGAETSSEQDSNGAETSSEQDSNEAETSSEQDSNEAAEQAFFEAAMEEWQQLIDAEKAWEDAWASAVAEATTKAERT

SEQ ID NO: 808 - protein, 211 aa, Neospora caninum
MNAFSSAPAAAAARRVALSFSAPRHTNVFSQPRFAVRPFPSRRLVGELPAERARNVADAHKLKCNKGNGRGQSGKAEQNTESGGSRGFRAAVGGGAGCMLAASPMLFTDYDKTASPKSELIFMAGNALGYCTERFFENEYGQSIFMFALGLAYLAMLGHEGKIHGAVWRMKHLFATNFRMVGHPRYAYALPKNPLLQETSTAKTGSAPAKK

SEQ ID NO: 809 - protein, 158 aa, Neospora caninum
MEDSNFSLQAETQQLREQYNAQMRMDSPSPRLQFEYACLLSCSPSREEVRESLELFDELLDIGFNRSDCLFQISLAHLKLGEYNLAKRRVETLLRLEPRNLSALSLHSLIIDRASHGKRLCVVSPAVVDVIKVDGDRDGGYIRWWELCSSSAPPAASS

SEQ ID NO: 810 - protein, 269 aa, Neospora caninum
MRFLLLALLASSLAVARGEPTPAADSSEAKRPDADRSEAKRPDAYRSEAKRPDAYRSEAKRPAVSDQAGLGYMYEYKKASASLVEMWRNYSRLDHAVRHLLRDYNVAVKQQRYRELVQRMARRQQQLELMMEQHKRGELSRHVVRAEITSLKELKQQLTVEFQELERLPSEQHPEKLLELIEFHETPVDLSSALRSENASLLRKSLKECSKLLHKLAKRQQEVSLLLKSLKYQANSSVHGVFVAQSAAIGNVFDPEAPLSIHMPVGKKM

SEQ ID NO: 811 - protein, 188 aa, Neospora caninum
METLDEEKAEALLREIVTLETYGSLSRKVARYELEKRMGLKEDDLKPFKDRISVILEKIVDDITADQENDESSKSDESDADKPENREPDGKRQKTGNNVNAPKNLKKLQASLMSKNEFLDKAPVLASRIGDELLFDMKPRTFSSGSCGWFYGSKVAIKVGKQEVWCQLGVNCTVLGSKEWDESRKRKK

SEQ ID NO: 812 - protein, 213 aa, Neospora caninum
MACRGTLSVRQWAVSLCIFVALAGESRFCTGAQGTVFDAVIDVEHPKHLSVSMRYGDQMRFFCKGATAIIPQAFKSKCCNAYRAICTPGNIESEYSGMFPLADEGFSFWSAGDGVNAAAMFTLPPQKNGNRYETRFSLGCVGARNQVSAVDVTIAASGYNLREHFEDAMKKPVHDEEEKNPQTVTESGVGADVLSPLGLLVSILTLASVSQTL

SEQ ID NO: 813 - protein, 227 aa, Neospora caninum
MSPPYVPSVAGAELFGHIEVAPAPSSGTKAGPIAAEEYQRELINNVGCMIAVIVALAVFQFTPKRKLSDFSARKLTHISMGTLLLLLKTEGKFAKKRDKGVILFNAIVAVWAVFDLPFSALAPMFYADPCGAIVGTLVESPKWKGDKTVAGSAAVFVVTLLAAYSVECIWHRVVLAVLCTILEAVGGDYDNMLMSAPVIAYYFLFQHQQHAVNDAWGGLSIRGGFSS

SEQ ID NO: 814 - protein, 303 aa, Neospora caninum
MTHLEFDVERPAGVSSKRLTQLRSASSQQSEDRGHGPRGPTACVGAALRDNVNEILRPAVVPRASSPGAAALDRMRVDDYAGMRSDGINELRAPVHRRCPEGGKRRGLMTNNESVFVSDVLGQHGRPINGASQFQDPRVTDYLQQQCKPKSRSLQRYYGPEELHKAFCTKFEVVDKTSGRTEIMTARRPGSAAAVVSLCDFDAYIPRPHKYTSCQKQISNIENTPLGLMPRKGAEAPHKPYFTQTAADICKKQSQLRCQDPEVTVHGQQKYHVASKASLARAFQISSMLLVRVGSHLETVHGQ

SEQ ID NO: 815 - protein, 224 aa, Neospora caninum
MAQNVFRLSGDMLHLVSIFLLLFKLYRSKNCAGLSARMQECYLIVFCCRYVDLTYSFISVYNSAMKAIFILSTAYLVFLMKKKVPISQTYDAKADSFNYLLYLVPPCAIITLVTADSFSVPDLSWTFSIWFESVAILPQLLLLQRQREVENLTSHYVACMGLYRLMYILNWIYRYLTESPPHVNVVSWVGGVVQTLLYADFFYYYVHARWYGHKLVLPVVGGEV

SEQ ID NO: 816 - protein, 239 aa, Neospora caninum
MAVPRSSTGCAVCSAHPASHAETAVRHPKPLITPLSPLSLSLPRFQGNWTKFLYALGILVATATQPVLCRLSIDGMPLPMAFELSTSVVYLFEDLPTRTQGQFAAACIVTCILGLVCVILKVIRRYVEKWLVSQENAGRTKVIFGSFPVYANGVRFLVAFVNYSWDYMLMLLAMTFNVGIFISLLLGIALGFFLLGDLLSVQLGPTKKPWTPCQCPNHPCYKQQETGEGTIVQRSPPPV

SEQ ID NO: 817 - protein, 559 aa, Neospora caninum
MAAPESNPAVAAPATVDQRSTVGSAEHDKEAQSDQVGREMTPENLEGKSACTGDKGGLNRKRKRGGHEDSFFPKKRDEMTPEQLKQRIKRQVEYYLSDESLTFDTFFQSKMREAAQQGKGEALDLRFVLSSPRIKSLNLTKAEILAAIADSTLVKVKEEADGTTLLYRETPLPELQERPQRGAAGGRREDGGAGGAFRIPQGIGKDPHAAGVFLKLCDIPENVQQWQQVKDAIKEKLPGEVFVKFVSKIDEVSVAGDKKTRRCWVYLGPFENDRETLQKMQPIKIPLGEGEAEAHILTDQEVRLCVQDLPPRIRMAREKDLQTLRRQLAALPLSLGGVPFKSVEHLRMCMAEFLQKTPVDQALKPNSAAEKAVKSLLDYHPKAYMKKGGRDREVVGIKVGLHDKLDSQSGERSKCFFVVRKKKGEEQNEEDEEDFSVSKCISELAKDPPCDAEELNKLLQKRYESVAQQRAHAAEQAQKRRKIREEAARVTGAAGAVEPAETSAKEAQKDDGQSADKNTENCNSASTESAAGGAGEQTGGETAAKVSSQNAESNAEKTA

SEQ ID NO: 818 - protein, 169 aa, Neospora caninum
MSLASVFQSYTQGKGDMDSRTLVKLCKETGMIDKQTTATDIDLIFTKCKARGAKRLTADDFEKVVEEIAARKKKPVDEIIQQLCSSAGPSFSGTKTDAVRFYDDKTTFTGVHAHGGPSTVDTPSTKFNSGFGEAGSLGASGATAQITLADICDRSTPDIRGVNKNFQKS

SEQ ID NO: 819 - protein, 253 aa, Neospora caninum
MVRTPWVGGNWKCNGTVGSITDLCGEFGKTGFDPKSIDVVIFPPALHASLAREKLPSKFHVGLQNCSKTHNGAFTGEISVEMIKDFGLRWVLAGHSERRQYYGETDEVVAEKVDIILQEKDLSVVLCVGEHLKDREANKTNDVVDAQLEACLPKISDWDRVVIAYEPVWAIGTGKVATPAQAQEVHEHIRAFLKAKVNEDVANKVRIVYGGSVNAANSTELILQPDLDGFLVGGASLKKDFLEIIASGLKKNE

SEQ ID NO: 820 - protein, 260 aa, Neospora caninum
MAGTGSGYDLSVSTFSPDGRVFQVEYAGKAVDNSGLCMAVVCQDGILFAVEKPKPSPLLLPTCLRRIAAVTETIGIAVAGLAADGRQIVTRARQEAEEYKKTFGVEISGGVLAERIGLFMHAYSLYWSVRPFGASVLIGAVQQERGEPGAPLQFKGELYCVDTSGCCSKYRATALGKGRPSAKTELEKLDLETLTTKEALEALTKIFLVVDDEGSKEGKVEVEVGLIGNDSCGVFKMLPSEEVRAAVKRAREALDEMDED

SEQ ID NO: 821 - protein, 459 aa, Neospora caninum
MRRQRTQESVADPLRLATDIFLETRIRFSFDADLESSLQCAWQSSAFPGLVYSIRRPPVSIASKMVNPGRMQRRRGGWKSQARKLMAVCVGGVLLISSGEAVPDQPREGLLRRNLQDALRRTGTLSGPEITGQVATCRLQPAKGKGDVAAATAALTLSKENLSVTLQCSGNKNAAVPEELEQVCKATTTAAKVAECKTNSPKEKQITLKTLLGTTRSIQWEKTNNSDNQGERRTLTLQESDLPLTDKAFFVGCDENNQERVQGQTECKVNVNVKARASSVGDGNVVTCAYGKDSNPKPLEVEMSTENNALTIDCGSEGSLYPTTESHTEYCDPRNKDVQNCTNKFVDILPTFVTSWWTTGPTDNSDKLTIPETDFPETDQQFRLTCVPNESTAPPAAKAVVVGKGDDESPEQAGASTSNCSVIVTVKTSNLTSIASSTAQIAAVAGGVAALTGFLVNTF

SEQ ID NO: 822 - protein, 267 aa, Neospora caninum
MTSTSVLNSLAAAGLDKMDKLEPSDQTVKKEYEQFKKDLTRQAVISLKDRIPRKILHFNNLTNVNADPGSLFPAADAEQTSKQDSAAGENTDTSVTTSGSLPPGKRIKLDDGRMCYTHVMPRHGLICEQLEQLKRDAAELVETLGQVKLWIQLNVPRIEDGNNFGVGIQEEAIQELARVEDWAFNLYDAIFKYYMARAKLSTKVLKYPNVGDYWEAIRELDEKELLHIKFTKVDMRNNYSMLYDLLCKNWEKVVKPKNEDTRSRMTF

SEQ ID NO: 823 - protein, 187 aa, Neospora caninum
MVTAFATSDELVTPCTYYTLTWGDAAAAPKKPADDDDFDLFGEESPEDKEAVKKLAESKKKEAAGKKKVVVNKSMLVIEVKPADADTDLDDVCKRVKAIQMEGVTWGEGMKKVPVAFGLFKLQVQCVILDDVVNTNALVDEIEEIGMTEEEKQKRRQKEDADDEDEDDEEETSGLVQSAEIVSFNKL

SEQ ID NO: 824 - protein, 382 aa, Neospora caninum
MGRMKNPFGACFARGKKDRRKESRKAAQEIPGKEEEEEQEEESIPLRYPLFDPRAVKTREEDLGEEPLSRPNSIPLEMATREHIELPADEEEDDNFMEDNPVLEEELPEEGKSASTVEEERAPSPVEEPARAPVPPPAKEELTPPAEEVEKTPPTPPPSPPPVEVEKVSPPPPSSPHSPQPSVSPEPVKPEPMPVSPPPKAREQYRAPIPEPAPPSPPVEETREESESRTSSPSVVSVRKVPEEPLNEPVFTPPPVIEEEPQMSPFEKLESAREGSLSDSAPTAPHTPRGPSDDDMARRIQAKLAELERQQTLAEVTYYRKKKRRSRCRLRPRWVCVEKAIDCYADAHDDFTAFFRERMNVHEKKDCGICRDFDFSDIPVLQ

SEQ ID NO: 825 - protein, 298 aa, Neospora caninum
MLTHLEVDEPKRQNSESRRPQRGHTRPAVPFLQTWTDSDAGLEQYLKGRHHLCSTSATKTSCHTKQTFFCFLCIVSQADKMTNCLSKLPYVSAACGTASLLVYFFPSTLLSCVPHSAETSPALLRLLSTLVNTSFSCLFGSATWVFFVMSPILRKTLSRCKLAEVQSIHFPIFFCASTVLSSTLLSTVCYMGVGYSKLHMAAAVNVLGNLVNSCYLAPRQISLLERRRELEEQLGIDNTDTAMNAAEVARRAARGGDGDQAAAALEYQDVVKAFKLHHSLGMAVGFVSFAALLPFLVS

SEQ ID NO: 826 - protein, 320 aa, Neospora caninum
MQQKAERTPEGASSRASGGASAAAGASRAASRTAGSQSSSEEFDSEEQEFSDMTGTSELEDMSWVEWFCTLKGNELFVVVDEDFIRDDFNLTGLASQVPLFDEALDIVLDNEQSEDEDDEEEQRKSAMAEQAAELLYGLVHARFLATARGLQLLQQKYAQKQFGVCPNSACEGWALLPTALTDTPNKHTAKVYCAKCCELYHPPKGSRLNHLDGAYFGTSIAQIFHMQFPFLLPTARSTTVSPPPYYIPTVYGFKVSPQVKTRLRLQQIPRMIHQARQRAEEEREALLGSPAAAAAAAGISSAADAAAQAAVPANEAGRR

SEQ ID NO: 827 - protein, 529 aa, Neospora caninum
MGGSCQEKKAHCVEHHGMTKGECDSEGCGHTHPEDAHSHSGCCGGHEPATVAVDPDSIADAGEEMTQGDKGVFKKILKEGDGPTPQPGEEVVVHYTGTLLDGTKFDSSRDRDSPFKFIIGEGQVISGWDLGVMKMKRGERAMLTIQPGYGYGASGSPPVIPPNAVLKFDVELLDSHPKPKDKWEMNVGEKLEGANAEKERGNEAFKKGNYAEAAAAYREGLDYFSYVENWSDEEREQQKRLELPLRLNLATCCNRLGEYSEAIEQTTKALEIDPESSKGRFRRGVARMAVGLLDEARHDFVQAAKLDPKNVEIRRELEKCKKKIEEVRAKEKSAFGNIFKKVDLYTEKQGIRNVAKCPKVYMDIKVGDKEPKRVVFALYNDTVPKTAENFRALCTGEKGEGTKGKPLCFKNSLFHRIIPGFMMQGGDFTNGDGTGGESIYGPQFNDEKFVDQHTGRGQLSMANCGPNTNSSQFFITFGPAPHLDGKHVVFGEVVEGQDVLDEVENVETDKSNDRPTQDVQIVDCGEVKC

SEQ ID NO: 828 - protein, 409 aa, Neospora caninum
MLGTGPSPGEGGSRTSPYWIVACNTDESHSAEQIFSSLKRAVLGPRNALCDEACLLDIPHLKFGTFDDLIRSVDILQKQDAYVESVIRRIERQALEIDPDCELKVVWQRHSLTVDQYIRRFQWDDAKYPRLRAISENLDTLVQSVTKTDDEVRAKVAVWQEVRQQMANTAAGKKTGPVNYFQRDLIDVLSPETVREDDFLNTEHLTTAVVVVPRGHEREWEQTYESLDAFVVPRSSRKFNVAEDADGNALWRVILFTSHVPAFRQAAQAKKFIVRDFKYSEQTYRETVLARSRVEAEKTKQETFLSRVCFAAFSDIFVAWMHLKVMRTFCEAILRFGVPPEFAAFVLRPVSEAKEKKLRSELDKLFSPKGGFGNSYFTGGKDDPGSDDEDFFPYIWLSLQPFGTHRSSA

SEQ ID NO: 829 - protein, 538 aa, Neospora caninum
MADATDAPAAAPPAAGGAAGPAIALGNIRGFGRNDMGLFKMSGDLFGWKNRKTGSVHQYKAADIVRASWVMTGADAYQLRILLGPHKNDLMVRFDGFHEKNFADLSRHFETHFKVKLQRALQAHRGWHWGDVKMEGNNLQLTLDGCPAFDIHAQEIAQVTTPSKNDLAIELIQDDTRDQQEDQLLEVRFYQPFAGDDDAEGPLQQLKQKLVKKSGVAETKMDSVALLNDVPLLVPRGRYEIDIGRRALKFHGKSYDYTIQYTSINRMFLVPRPNSPHVNFILSLENAMRQGQTSYPFVVMQFDSESVHSVEVNLEAAELQQRGLEKLIEGKTFHVVTRLFRALVGKSVIVPGDFKSVKQQFGIACSYRAQSGHLYPLNRSFLFIVKPVIFVRYDDVVSVEFSRTGASTTNRFFAFTVSVRGGGEFEFTSIDRNEYKPLVDFLVEKGIRIKNMETPEPSRGGALEAADLPSDDEDDDDYDEDGSDSEDEDFQEDDDDDEDDNASESPSEEEEEETKESKKRKKKEKKSKKEKKRKKERD

SEQ ID NO: 830 - protein, 112 aa, Neospora caninum
MSRGKKFVALALALGGLWAWALFRLVSRHSLDASQVKDQVSSVQHLPWHDPVFIAVFAAPFLALALFGIYAVVTIVTQVIRFEDKKEAAAELAQDLITARADLQRRGYQFVN

SEQ ID NO: 831 - protein, 221 aa, Neospora caninum
MVPLYTSLFRPYGQLLNHIPGRFLSLSRPRVDYSLMLSRHFSSTSSVTKPPKTDAAAQHGEGHDSHHDTNNFYHMPSHHSASRHHLNPDGTMRNLTTAETFHWEHAEAETPAQQIVSVNGRKMVKGVETRDLVELFLVHQKNMPFWPRMRMNVWGNHDLLMKAEFVFFWTPTFIIWSLAIPVFTLLYMLDEAVNAAMTVKVIGRQWYWIYEVESPVDDEEE

SEQ ID NO: 832 - protein, 354 aa, Neospora caninum
MPDHKRTEAHLSTCHPFLSCRRRVRLLGVLVIIVIAQGLYTTAFSSAADRDSEEHHGRVAQPQMRANPASSGDSPREQLPLPEGKGRTLATLVHNGISPGARLMIQGLRNLSEAQRKLAAFVHDAAKRCREGEEQMCETPGEPIGKRSGIDLPKLPVIRQFVLADDRNAGRSSISSMSDFVRTHASTVVATSIRTPRRQRWKPPGTRTSHPLQPRWGTNRLKGATETDTQEVFIELRAGGFFDMLNNMFLGGVGSADPANFEGGNQGSFFDFMYPLQTDYPWACVCDPNLYEKWEQKETPHVPCKNQVDMSAQGVTAYCNPLLHKINSAFRPGYGAFVFSFIVVSLSFVFSLFI

SEQ ID NO: 833 - protein, 379 aa, Neospora caninum
MVGATFALRGHAARDCVRLFVVWATISTHLLLCCSATSNFLYDVRLSVFSGLGVGSHVEGKQLGRLAIREYSRPAEPRAVNSKNQFSGGAGGAAPAFAEGPTRAVRASWISFSDSVLSSAVEAATREQESAQAEETQPSSTYPLLSLRLEPVANQEDGKNQHTKNIPPALEASAPVFSFMRESPRPGSPSAVCDTEPPFLLSLHVSPSLVPFSASIQRVPDGSSGQIPATQTLEAARSLDTGSANAVSERFVVTCPDVAQASKGQNAAQSRSRVPALQVVLPPTKAAKDALIVPAYFPGEGQHRAPSVGAPGQEGEGEKPEEQPSFWRRNWWLILGVLLMASLMGGDSGGASPQNEQGTRGAASANPSQRPREGIDRRR

SEQ ID NO: 834 - protein, 244 aa, Neospora caninum
MTQSMLDMSLDDIVAAHRDAAGDAPGRGGRGRGGGFGGRRGSFRGAQAGGGFASSFRGRGRGFSSWRRGDEDWEDSRSHAPFSRRRAFSPYSTPYSDRDGRWGPSRRGDRRGAPAFRESGGRTREPTAVVRVSNLDYSVLEEDLKELFAAVGEVVKVWLEYDRTDRSKGTGGCIFRHLSDAKRAIELFEGRRIEGLPLRLELLPPRHQETRRSPNFGPYGQDAFSRRGDRGSGSWRGVQDVEPW

SEQ ID NO: 835 - protein, 285 aa, Neospora caninum
MEMHASGPTPSQLPDGERLPSAGYPNGGVEERKEDVTSSAFSFPAQKTAPANPVSGREGRDSGAVEPGARAEGMRALEEQVQNLDSDWDELQKLQYMTEEAAYSLVQSGASPHSAGAAGPTDGASPGGSQNVAGFANTDTDEVDRRSVYVGNVDYSSTPAELQEHFKSCGTINRITIMVDKYTGHPKGYAYIEFNSEAAVQNAILLSDTVFKQRQIKVVAKRKNIPGFARGRGWRGGRMAAAGGMMGRGRPKRSLNLERDRGARGGFRPIYRPRGGFARGYGRPY

SEQ ID NO: 836 - protein, 756 aa, Neospora caninum
MECRRRTLALRVALFSFSFFLASRLVAAPAEAADRSKGHASAPTKGSETGPAASSEAFRALSAPDAALVRELAGAGGPTDDLPLVVPTDAQALAEAAAARRHTEGCSETEERTGESNPVPEGEARTGGNDQQPPADGAASQCTRVGSGATSQRASSMRYQTALAATQLFSSLEGARSDAGSREPLQRAGTKSAARAAAEDACAEASHPRHSCPLWGGSYDERRSRFLLRYGDLYNQEIEEIKERELERFKGQVYMDYADDRLKEARSVISRFFDAPENEYAVIFTSGATAALKLVGESFPFAARLSSFYYLRVNHNSVLGIREYAYAKNAKSVRALSPREVERILTEREQRDAPSDDNDASRPSCLFAFPAKDNWNGRFFPQDWITRVKKLGLSNDNCRWFVLLDAAAYAPTSPLSLARHPADFVAFSFYKMFGYPTGLGALLARSEDATKLQRLYWGGGSVAASVCDSRWCARKTNFALRFEDGTLPFLAIVASLYGFRALEAIGMEKIHHHVAALTTHLFERLQLLRHSNGAPAVLVYWSEPSPPTGRQPREREGALPQASGKVSTPSQTSADFLGLSAEDIIRNSQKRQSCSDPSGATLSVASAVPSLVTGLGGGSLGGGVYRKPAGSVRVSMGYLSTFSDVDALVAFISETYLWGRPPSGFCGLRMAGRPLRPGELRTGAQTRACAHTFSAHAVTKTGRRRPRSDLQSASLGAPLANPRLADFQFPPGSRERKALQVLGAQDLPPQREAPAF

SEQ ID NO: 837 - protein, 430 aa, Neospora caninum
MEAFHRNNSAGPSDCSTVVDPPGVARVASYFGTIGDNEDPPDDSGRSHDDSHYDRQEDVDIFSDLGNFMPGNLSGRASNLWNYVARRSSVAIDSFLQQHRLQQPFAGQTATCQEELLSDRTHSLAAAEIKNLSCPKYVLLLFISFFSTDVVKQKLSRLTLIEALEHFDMVNDFFFLVRVAWAIHRGFHWRENKSAKFVMAWLVTTYVISCCAYALRRFLIYNRISQKSSALFFPLLVFKEIRRAGEESPEVLFMFERLCWTYQLLMRVIEDLPQVLLSILFLINQGRDTYAMVMISYSSTMFFITTIRMGLRYPFKGTLYLLLSSEPPVDDPVALEAAPTTYYMTLFMSGVFALWSGTYLFTLRYVNKVWRVLMIMMAVGFALLSLFCLLLFVYYRRQREVNVDEAFLGGTAGDGERHRAGGRASVVSDI

SEQ ID NO: 838 - protein, 306 aa, Neospora caninum
MSVAMAPRFLGAKTHLAVLLTVFLFCMTVASCKEGTSQRAVPPADVPTCTEASVISFFPPRGDESRATSKEGDASKEDESTKKARPVKVHFAYGRGRTAQKKPMKVQIPATLGTGYTLVVLDVYRGLDLPVDFREEIRKKLGGKKDSGAPAASSQKAEKTAGKTAETTAEKAREKTAETTAEKASEKTAEKTAEKASEKTAEKTAEKADEKGTTATDDEDLEDVLFMKVFAESTRKNGLTISPPEKTMRSLPSTVEGEKGRLSRQALYESEIVPGEAGDFSVAFAYVRPWKLSDAPEVFVALAHFD

SEQ ID NO: 839 - protein, 450 aa, Neospora caninum
MALSPLRKRVAYFYDPDIGSYYYGPGHPMKPQRIRMAHALVLSYDLYKHMEVYRPHKSIEPELCLFHSSDYISFLSSVSPENYKEFSLQLKNFNVGEATDCPVFDGLFTFQQACAGASIDAAKKLNHHQADICVNWSGGLHHAKRSEASGFCYINDIVLGILELLKYHARVMYIDIDIHHGDGVEEAFYVSHRVMTVSFHKFGDFFPGTGDVTDVGASQGKYYAVNVPLNDGMDDDSFVALFKPVITKCVDVYRPGAIVLQCGADSLTGDRLGKFNLTIKGHAACVAFVKSLDIPLLVLGGGGYTIRNVARCWAYETGVVLDRHREMSPHVPLNDYYDYYAPDFQLHLTPSSIPNSNSPEHLEKIKTRVLSNLGYLEHAPGVQFAYVPPDFFGEDNDDEDEFMQNQVENEGGGRAAGASTATSAAPYRIRRKDYANDFEDMADRDQKVPI

SEQ ID NO: 840 - protein, 155 aa, Neospora caninum
MAGSYFAVRAGSRVLGATTNASKVSYLARQSSLPSPVTVPALASLRVFAPSSPAFFCSLSRTRFAANAVQSHSAGSHAPAATVTPRYTDDIPAEYYKYGIFKNYRRDDSPLRSLLRLSITTALLLLVVFLNHHASCSHWHYKHRITGSYLDSDSE

SEQ ID NO: 841 - protein, 1357 aa, Neospora caninum
MELSPLLLQGSRTGSGGLLVQQKPAHAFSRSSRSARVVFVLGFLAWVAVVRSGSSEAVALSVRTPDAGAGPNAVPPADRVDGDSEASGLEAEFAQAAGGDDAPHGNISADLSRRYRERSRLQATRETTANGDLPDTPQSDEAMPPSSESGKDASENVPGGDEDEPGEPATKRDLNPETVSPSELPSTDSLVTSTNAQGPDRSPAEGTPENSHQGLTSSGHAAEARETDNTRPAQLGGAENSTEATGPPETVDAPGSPLSTGDTSSMNPNTESEESAHVPLRASSPETPDSVGTHIGGGVSQNSTEMSLTRRSGMHAFPESSVATGSAGGAEQNQGNSTGNGGTAAASSPEGGAFWSESESVNEQVEREPDSQFPSSGPASLDWDAKGEDTRHSGERRIGAEDALEPGEEDLTVTSLETEQPFSSMDEGKGTDEDEPDAPSSPAHVVAEVGNTEASGHQLFATDPGHLQYPVTTDEERTGAAEPVFSLSKSDDAPGQREEPSTNATEEVREAHIPQIQPETQAVAPSSSSDAAQPRAAVDPERSDAPSGEVNETAAETPSHPESGTPADSPLSGPLEDLSGPAERHPAQLAASAGDPELLAPAKESEREVHGHAELDRQAVAVGVDDENDEQSLHHGGATEDTDDRSSLWFAYGDQRRPSPPDGEYWSVNGVSESEPAQEEDTLFMFRPAHQRLDVPQSEGVGSFETHKRDAGWPQGPHASQFPAKESPPPLHTRRPASFSFFGRPSPSSRTKQHETPYYMGHQSDEKASEPAYAPSPIVNAYGRFGGRPLEERNVLVPALADGDENVLVGLQSARGAREPENTARGGDADHGDAEVSSPRRRAEPDADENEETTGSDNSAESQPESGPHLSPSADLSTSTSSSPSLPGASAEEHGVPSVGGAAFAPVSAGDEPEAFTSGDAESQEMAQAGAATEAQASAEGEQAAPSPSAASASSATDQGKLTARAGSVSDPREGRCSREELDALTEYFSGQSDTCSAYRCIEAQGLEFRERLKEHYGSVFSEGQLDELAGLFAACYCRCPMMKCEVDYVMDTGSTSCKEATVEYCEQSNEKFVDRCTSAAEQLPLVYDLHADTGGFKQPCRVCRREDLPQSGVGSVAHPSPSAPSGGHASISSDEQSALHSGSPSDVDGPPFPSDGRETGGETGRSGAALGHASGHPAPSAEDVESGRNEVHGEQQTGAIGAGSPAGWGDLFSPEPPTSHSGSSPPAFNGDEDKEEGDAGAAPEVSTMPSSQAGAGGASEDPSPLLGGDTVAGDTLHGPGEVLSPSGPNQGSPSSITTVRPTTTGNTSSGSTPTEEGGEAGSEAVEVMNQGGAVGPASGILLALVGSLLGIVTLVA

SEQ ID NO: 842 - protein, 502 aa, Neospora caninum
MRRVAVLKPEDIETRLFIDGEFVEATSGNFFDDVNPATEEVICKVQEASKADVDKAVEAARKAFPAWSLSTSASHRARLLHRLASLVEKHADELALIESVDSGKPISSIHTIDIAGVIRILHYYAGWADKIVGKTIPVDNPDEFFCYTRKEPVGVVAGIVPWNYPLYLLVLKVAPALTCGCTVVMKTSEKTPLSALKLAHLIQEAGFPPGVVNILSGFGPSVGSALAAHPHVDKISFTGSTATGRKIAEAGLVHLKRVTLELGGKSALIVCADADLDRAAMIAFYGLFPNSGQCCVASSRVFVQESVHDAFLDHLKTFVKTHLHLLCPQDKACTQGPLVDKIQFDRVMKYIQQGIAEGATVAMGGTEKEGKGFWVMPTIFTDVSDDMTIAKEEIFGPVICLLKFKTADEAIDRANESHYGLGAGICTKDIGLAYHCANRLKAGNVFINCYNTTDIAAPFGGFKQSGYGREGGEEGLFPYLEIKAVYSKVDHPSDVLPGESAC

SEQ ID NO: 843 - protein, 366 aa, Neospora caninum
MVSKVSGAFCAMKGPAIVVGLLCLSGSLLLSNANSTDATCSESKTLASVALTKESSPIKIKCPDGSDVFPAVTDKSNNSYCTDSSCAQQAPLDPAFSIQADAAASGAVGGVGVSLQSAKANAKSYTLTMHQSSQNSSTLYFQCRTPGESKARSREEFLKKRVEESQATETKCTIQVAAYGSEAAAAAETEKECNLGGKLSVSLNPKSQSFTFHCAEGSSLQPVNFENAFAGNQCADQKALTEFGLVASLLEGKSAASGTPAPPASTGALPAYTFTVSKFPAENTPVLLCYKCEKTAAVSEHVDETPSECTALIEVSGESATGDGQEDNQDPSELGTSSGAAKHAADTLLIALVTLLFSALAVDASV

SEQ ID NO: 844 - protein, 538 aa, Neospora caninum
MQFSTVLCVISTLVVGGTLVECGESGKVYAANETADAAPASSSAEHDVESYQGMGESPLHTHEEANAGAIASESGDSHPSPGVVEGAGGPLHLVNGSLPPFEEDIELRREDTTRQSLVASVSQQPPNLAKVASRVAAPLLAAFGQKSASHIAPRLDWAFVRDVLDDMKDFQTAGLGIGAHTGDQVADQARQKQSFYWMSPWRWWMFYVKLPDLEVKKYEEMKDAMRAFENSSEPVTRQVYAGSAELARALGIPPAALARGFTVKICHLSTTQPWKALTETFLRKTFLLPDWQFFVPLLAAARGTAVAATFQFFPRTRGSLRQLATQVPQKLNVVMVMAEMVAAVEALHRLGILHRSLSLDVFYVNREGHIQLGDFENATLDGVYRPISDMAKPVQEVYMRVLRRFNVAVLQTPAADVFCLGKAFESLADLTDLEGQERLLVEVAAARMTQAEAEKRLSLQEVMENKLFEGVDFGAVRARKNPSVYGSYALRETLTSTDGNASTWADDSDDESLYDPSPDGKSAYDTEWKTSSAEPTRS

SEQ ID NO: 845 - protein, 1264 aa, Neospora caninum
MESTTVGAMRPKAGRTGAAVDRTGEQMTESDVESANNGGVLLPPPGTIYEEKEGGSMRSALGEAGEPIWDVARLPPGKNSESRFADSAHASLKVSLDTAASPAASSQVPSRRQKGHPVYPVSSSLRRGQAAELDTGKLAGDTSIREPLLALSSGQDNKQRYLSVSGEETGAVAEPRQAKEVGLGSGSSPTEENQSSPKPSDSSGFPLLSGTRRSQSTTLPGANGGSATSSQSPSSEESPLRRPIDASSGFPRDEHSVMEWLMTGTPFGSYLSSPSSKERRSSVASLDGEGSEIWPDSPDEEEDPVKLSVGPNAVDEEEEEMNEGGEEEEETWPEGDDQEDEPASGQAPSFQALMKRLYRPYCRRFAADPRWQRQFGILVLSAVEWPLYTHKKYWNQPAIGKFFGTLEQLTDDKNDDLLTGPNFRYATQIRSCGFDAILRQQLAGLRKTVNNLDEFVALVRAQKTVDVKLQEMLAYLPEHKLAIVLTRPTLGNLYQAVSQLQILYYYHAAFKREEATKVWQWMFRSERRVHWSVLQLLGISNQVVTPKPMHGIIILQIDKVESREKAVLELFDFVENKATQQALLKFESTVTSAITMRIRKVAKDFRHVLSFGWLSASSDATLGLPDCIVTAFYLNPGGAEESPRVPPKRVRAAKRAGTRPRLKNPEGHERTNASAVLAGANDQTVSEPAYADESGDPKPRRGRIVSGSGDTVVAEGVLSVSSSPSVTTDTPLAPSNAALPDRIRSLSSVPDTSKLHPIEIGQFGFEMDASVAQNLKEKLPPGSMYIQLSLADAWDFQPQSRVDAQANVIPAYSATQILKANLDWDPSLVGVGMAYVVYTTITDPYSSSSSDKAKHQEYDNDRNLIIRVPSSVFRGEQHFLDEVMSMIVVPSLQDSASRTVAPDRLKVMGTARKLSVGDVLKTGMFGVGIPYSQHRVIESMVDTESVCVHLLVRGLKEGTRENSLELPGVAIFDRFIRRSRGKYMLVFVDLVPKQKAASTHTKSQPLRQSGYPGWVLLLSNICVALFFVFVIVCLLLNHHMKLPWWVACICGSRNPFIREPDCASCRARSPVDEGFGGGGSPVVLEPIQPAGDELCAGHPDYESFRAGDTQSPLEPSSIFHGSPATPINGVDRRERKGNSVVETAQASRARETSNAGDERPYSAGKARGNKTRNSRQSTPTLAVSDGEYMPYTPTVGRESRRSWGRGPTAGYGGDRSCSSRASQGGIEQLKALEIARVYRENRIDAVKSMERRRATKRPTDDSVT

SEQ ID NO: 846 - protein, 785 aa, Neospora caninum
MYAPSGLAPGAAEGRAPSAPVSSGLLGPSQQLQQLQQLFSSQQPANFPSFFPSVPGAAASATPAPGLSLSPPAQSSFFPTAGVAQPPSGEPAHAVYPHMPFGAEQAGRDPGAGVKTQGERGGSGEEAVRAAQEQLSKLQHLFAAGQGVAGQNGTSRFREDERGARARGDAVGVAGSADGAGRGQGEDGTTGRMAVFIDYPAAAFSLVPEDVRNFLSVFGTVKQVSLSRRRAAADVLISPAAAVDACVKELNETFLPGFGVLRVSPLAARGPPIEELLPASTADPLAPPGVGKAAPAEAPPGRREPDEARFDRREAKAKGDSRKGDEDRRREGRKQVCRLELVGLFTYEPEFDVTRALLGEHNGNISYIMDQTQHKVDLSIKGKAVNEAPVAERLHLSLSSDDAEAYEKALNMAEDLLQSVCEQFVAFCRSKHLPPPVTATFRRHQYEQQPDGSLTYLGVTERAPVWLGSSPSHSSSNRGGSSPPPLASSPTSSMAPPASMAPAGLSGPPAASALLPGGAGAQMSSSAPVAGLPGPGSPSNGASAGLPAASLLAAPHLAPMPHPLPHPGGLPLPGPLGHPHPVGLPALSSPSGAGPAPHGALGHLPHPGATPGAPGALLAHPAHVSRPPHLDPLAGPHPLGLPHPHGVSHLAPPPGSFLPPGALAPHPFGVGPHPAPGGVLVPPGLGDFAAAMEAALAASGAGGRAPGNRREGRRSRSRERGSRERGGRERDKRDGQYRGGSPAASRRGRGASGRGPSSGRGGRGGSAGRGDSARGRGSVGRGEGR

SEQ ID NO: 847 - protein, 208 aa, Neospora caninum
MSRLDPVLFTALNSLPAEVTEATREPVPTAGDLRVSASIKNNMRSCIQAAFVPPDSGIVGHLLARGVSWFYVLEPHPPPIDPENSADPSRAVADAANLASGTTRGAAPSDGEASVRPDASTQGDGIVGLRRNLALLSYAAFYVDRAARWSQSGCQSRGRSASSRLPAPPASSSTRESASCMHQRRLACRRGNSRITNNARGWVRVAGG

SEQ ID NO: 848 - protein, 191 aa, Neospora caninum
METVIGIRGRTFALVACDRYANSSILRMKDDEDKLMLVDDNKVMGLAGQIGDRLQFGDYIQKNIHLYRFRNNKKLSCAATASFTRQQLAYYLRRSPYHVDVMLAGYDEMGPHLYWMDYLASMASVNKGAHGYAAYFLGGLLDRYYHPELTEEEALKIIEMCKKELMTRFVISQASFRVKIATKDGIRTLDI

SEQ ID NO: 849 - protein, 212 aa, Neospora caninum
MDPYCIVTMGGHTFKTNVDDHGNKTPRWNQTFKMDYAGEAQMRFKVMDKDKLTKDDYIGMADVTLAPIVYGTRLYNAEIELTRKEGKRAGYLKVTIEFDPKKKADTSSPPAATPPSAAVLHAAPATAYTPGYSPTPLQAQPMVGTPYYPPSSVTYAAAASGYAAVPPAVYPSPPASYAMPPGAPGYQPPGVYGQPPTGQPYYGYPPGYYPPR

SEQ ID NO: 850 - protein, 402 aa, Neospora caninum
MYDYAHGQSDSIENITHSICTLEFELHRPLYDWFQEKLEITRTRQIEFARLNVTYTVMSKRKLLALVTEEWVEGWDDPRLPTLSGLRRRGVPASALRDFCDKVGVARRESTIQVEVLEKCIRDALHQVAHRRFAIQDPVAVTITNYGDSVETVTAANHPEDESFGTRELHFSKRLYIDREDFMENPPPGYRRLAPGAEVRLKHAYWIKCVDVIKDASGLVTELLCTHDPQTKNCSVAPDGRKVKGTIHWLSEKDAVPAEIRIFGRLFTKANPEEEDESNPNASWRDNINKESLKVYNGFVERSAADSVAFPPQSSLQFERLGFFTPDGSTLPEDAARNKASTTPVFNLTVALQEGFTATDDADKDKMKQQDRLAREKAALERQKKKEEKEARKKMKEQQQKA

SEQ ID NO: 851 - protein, 1134 aa, Neospora caninum
MRMPLPVPPALSFVAVPPVAAAAQKFAAPPGAAPRLTGQPVGSDPYYYTTPRALDRVVSCHPTSPPVPPRSEGRDLPLRSEVSGCPVAEGRRLNPAAVTPPRGTAESRYSEASYRSHAPLESRYYVEGAQSLSQTERGLADLDMHSFEFDGKSPYTRGERRKLPEGEMGLESRNGGFPHHGPQRSAWVGRPDDRGERYRRERLEDDDFDRRPYASARPAYKQTGGPVQQRSPSYSPDRRARGRSGGREHAGWSYHAANGGRLPGAPPQRHLEGDRYQSKDPFHGSGYSSQSRDAGVPGRRPFLAENHRRGSCHPCAFYAVGRCRNGEECRNCHDEEHSDPRSPLFALDVLHRKGLCIVCIDFKKKGMCDDPDRAHGMLYCHHPQHCSSTGDYAEERRDNAAYSSGSGTRRAPADHSPKIRRPGGDWGDSHVSSGRCRQREDDYEDYSGRESARRRLQSPERSSRGYGSSARPDSGVSGGSKYMSPGKEDYCGRERGPGGGGSGVRTASLGLSRGVQPSNSRMHPPRACEERRCVPCAVFFAEGRCRQTDCSRCHEPCHGTASSSLFYQRVLHEMNRCEPCRAFADGCCPVNEAVCRFCHDPSHAGDRLPVLKSPSAPYYVSRRGPYEANPGRSAGGSSYRGGREDDSLRRREPLGGGRGGGADVGSRVAAGGDSDRSYPSRGPRVQRVERGGAAYGGAHPERCVPCLWYFQHVTGCGKGRSCTGCHHEDHRDPQSDLHPSKRLHVLGRCVPCRNHFKGICPRQAEACGFCHHEDHGNVVGSKDDGRAGEEERKEGTERKEHDGSRSHETRSSESGGQATECSVDARGNKEGEGCRAPATSELGEKAGGGETGGTGGSPDSREDKLTEKESGKEGDSKSARNATKTAVSYVRQRGQNEPRAHERGVCRPCAFYFIGPQGCLKRERCPDCHHADHANPHSSAHPSKLLHLKGTCRPCIPFQRGNCQKTPENCVYCHHSSHLDEVSQDRELGDRHADAVEENEQIDATEFPVQDLDDDPSCCQEDHPESSPSQQLSPGDSRHSSRRGGELGEAPPNGDQGKSGSSDGSEVGRVTEYTGVSLDQVKRPEQDAGDAKGNTGGEDASVADQSCPLDGPPRPYGDASQDPAVEEGAKDKSA

SEQ ID NO: 852 - protein, 694 aa, Neospora caninum
MSRTERDYQYASDSTYPGETHSDASAGSVHPHGADPSSFASVAPPTYAGQALPPLASSSCPYPYSPSSYSPDLGPVTSSEQASPHSHPHPTYPPGYPAAYSPPQPLHHAYPPPKQDGYSVYGGLNATGFGAPTYHPHGHAPSPYGSQEGSPYPAPGGYNPNPAYPGGPGAAPGWTSGPGAGPRRIPQSPGFGDQRARGPDTPWRHSQLGQDGGNRRGRYDAGTMGSHLVEPKWSEEQLAPIKKDFYVEHPSVASRTEDEVAAFLEANAMRIDGQEPTPRPVFSFEEAGFPAPIQNQLKKMNFAEPTAIQKIGWPTALSGRDMIGIAQTGSGKTLGFLLPGLVHASAQPPLAPGQGPIVLVLAPTRELAMQIRHECMRFTEGLALSSSAEDQEGGQRSGVRFRTACVYGGVPRQGQATELRNGAEILIATPGRLIDFLDLGVTNLKRVSYIVLDEADRMMDMGFEPQVRKIFSQVRPDRQTLLWSATWPKEVRGLASEFCRTRVVKLQVGKADLQANANVTQRVEVVSSNQLQHRLLSVLQEDIAGQKTLIFCETKRQCDQLCRELRYRQLRALAIHGDKEQRERDRILHDFRKGDCEILLATDVASRGLDIHDVKFVINYDVPKNIESYIHRIGRTGRAGNKGTAISFFQYDFYSPEKVTMARKICEVMRSVGQEPPPELEKIGAPRASSRSRM

SEQ ID NO: 853 - protein, 1000 aa, Neospora caninum
MSRSSPLVPCSCCSSLVSPQITPSASSASLLSFPACFCSCPPSSCPSSLPSSLPALFRSLRPPYAESAMSVSGSKRPPSSFRATTGFALRQRPAFHAAHAHYLPVARAVSAPRSRAVASFPTQAGVSSPSSSECHSLVPSLRGILSSLPRHFLRVCNFAAAYSPRSFLSACTVHASASASRPSYDSSPFPLSLSLTASSSPSLLVAPLRLSLPRSSAARLHGVSQEVETARPASPSWDCSASPESARRHAIQPPLLSLPSLGGTKRLLSQLMRRLVGSAFLALPVLFLLSQETPLFAVYPERRVAVRLSLLPRGERAEPEEETREEGEAEGQRERTDGGTQVRGGCERDGSEGGSGVESLARESRDGEILERGGDAESRNQGDDGFAPPLVSAGEGKTPGSSDVSREKAPAELSLPGHETISLQAASSDASANSGARGARERQDDNGEDAGEGTFVLASPWAVQAFSRGDLVYFRHPMDSKCKLLLRVVAVAHDVIRVSASSLLSIHPTLRKQLLVFGEPRVVDANGVPFRCDVSYDFLMHLVDCCNEEILAAAYQGKRARWFSFQPAGESEAGATEKGEAESGSDIFVELKIPAGSCWLEADADTPRNAPAPRRPMRDRHMQSEKAKTEEESKSLPAKREEDLAGGKAASPFAPASVLPSSLVSSTPDACQASECWTRGGDLEACLPPMCQDSYSFGLAPVGLIQGVVYAILPHTHSEGEAQLLLCQAFLSSLVAEARESRLLTWSASLGEKAKRAVAKAEAYLGGLRVREDEQASGKAACAPLSRPDERQGSAQCRSRLEEDSELGSWQSVPVTGASEEENTLHREDKETGAEAKASRATAEPGEDTKGHGPLCPEAESGRAGGLAVPPLPNLHIVLPTQRADAREGEGHDVMETERHREEHGRPEERGEGRREAGETKANGHQEDGEREPERSDDSEGEGLDEVEEAPLMYRLLSRATQWLIAHADMRGLALPDDNPVSSKGTIVVDCSEYRGERHK

SEQ ID NO: 854 - protein, 763 aa, Neospora caninum
MSAAAEAVGGASGLSAAPVAASPSAPGVLSAAVSPGVSLAVSPFFPLFRLARHEPVDAVKEAFEKTFEKHRQELVERHPSLEASALQALQEKLIQDQHLLVDPTSRGTLLFEIAQRSKDEEAVELAKFLVDEKRVLTVAQRDRMQQTCLFYAAREGHVALCRFFIERGCDPNAQDTVGQTCLFYASREGRAACIAEILDRGGNPNLIDINRQSCLFYAARDNRLDAVRVLLEKGADPHVKDTLRKTAWHFAKANNHLAVCSLLKGSGGGGAQTSAAAVGARGPVPVRSCSSISSLSSFSSFSGAAPTSPNAGSAGLATGAETPAASLETPDGAGNGQAGGSGKPAPGVGEAACGEEVPQRKKYRLQFRPLPDECPDLWLNAGNEKLTEFERLFPALSVWRRDAQETGSAAQTSNEGGASVASQGAKEASQNHYDSIRLALLQNAQQAALGTGSPGMDLLGLWQSAASALLSELSKYEGGHIFEKPVDPKTAPGYYDVVTRPMSLSCIKAKIRKSDYAHPQQFLKDVEQVFINCEIYNQQGSWVWSIGKNMQKFFTNQVMITRFQDYVDKYNKIYNVLAECEQENQRAKAARTDGDTSGQPEEPKTEETPNASSLEESGEASAGRSDTVELAPSVESAGAEAKAGEESGDSGEKGEKAMKRENAPSAGASDGEEARSRESRKAEDAETGKSEDERRRDSRRSSAASGKESCGRGEEAKTEEKESKRTEEDGGSAKKEKDENKGKDTANADGRKRRRDEAGEAAT

SEQ ID NO: 855 - protein, 744 aa, Neospora caninum
MRSLSTGRSEADGRKRVEFLGFICGSLFHRGALLGFAWFFSCAFQILQFFADPELSFHENLWGFVHFVDDFVTMPCYYAFSTEAMDAVRRRANRVMSVALMKEIQPVAFKHTWRLRPRDVDASFFSPASSSDSVFSSIVHSLPVPGSSGGSAGIPASIYEHPEALLPPSDPESFVFPARGKGRDRRANADRGERNVMEEILSFAGNIREKLSFSGDTANQGDSASAGFAPADGDRGVQAPRGEKGKGKEIEVSHTSASRQYWRLLPPLPSHENSRHEEAGEFAGGFPLGLGVRNGNRAEDSAGATFTTINITAYFPSAPPHASEDERQRNLEEAFSLLRLFASPHSRLHGEAGDLSASTPEGSLPSSATAEANGKGKWPGDGGGGREDERQGGGKTVASSEDGREGEDALPKANQGGGKATEDALGREPARASEQVSKQHTRQKTWREKLKLVFGGGKTGGGADDWPDELFEKHTEFVSPDLLNWREERGESETARRKDTTAGRPALFFFHGGGLVMSDHRGYDKLLRRLSNLLYPSGALVFAIDYRLAPEHKFPLPLQDCLQAISFVVDQAKMFGVDGSRLAILGDSGGGSLAAAVMGEALRRVDAFPWVKNVRSLTLVYPSLCRGCATRSQIVDGSLFYLKRDIWFSLLYSPAIGAPDDWRQKPFTMPPALLRQFPPTFLVLFTHDIMYDIGVLFHEKLRRHGVRTGIYIAPGFHGFFGSDRWSRFGVPSVEWTADRIMKSW

SEQ ID NO: 856 - protein, 525 aa, Neospora caninum
MSYMDSDEEASPEMLMQYRRAVEMAQKEDLSAFDRSGLIQSLGKNKDNEEVLLITFCFLTGAADELEKAMHYALAKLHEMENQPFAVIFALAMTNWLNDAVSVLKQCYLSLPRSIKKNLKKIYLLHWTLARKMVLDAMSNVVSEKFWKKIVYVEQLSDILSTLQMPPIEALTKIPYVVQHEEEERVSPGSALTIYGTPVATLCARIPTNIVPPYTRLPRIYVDFVDHITSREVIGTKDLFCLQADCASIYAFVGDIDQGNPFAEWTNIPALITGFRLLFDCLTIPFLGEGAYGTFSALTKAATAPDKTKLLDTVMQVYSSLSPGEQEACSYIMKAFKVISGESSQNAMTPLRIAEVFAPSFCRPPTKPDSQAPIVTQMIVQAISLAIENAEKLTPNAQPKAVQPAAAAPAGKAAPKKKRAESSSSESSSSSSDEESSSSEGSSDEAQKKANGTKPAAPATVPARPPAAPAATGEPETATAPAAPKAAAPKQQINRQASAGKRPSSSSSSEESSDDDTSSEEEDDD

SEQ ID NO: 857 - protein, 262 aa, Neospora caninum
MAATPAVGRGEGRSSAARQRIDGASGENTSFYEEDSRSRFSAEQRRARELQVFLFVPNIIGYVRIALLFAAAIAWQKASTCLFFFCYLTSQCLDAVDGEAARRLGQVSVVGACLDQVVDRLSTCLLYILNASVYPDFASAFFLALFLDVGGHWVHFFASAVVGAKSHKTMDPEVNPVLAVYYRSRPVMFSAILGFEGFFMCLLLLSAPLVQSSFSSLHWILLVIVYATSPLMLFKTLTNLLQGLYGARRLVACDIFAAASSS

SEQ ID NO: 858 - protein, 563 aa, Neospora caninum
MASFFRQQATLHQTPFYLYDEARIRENCRRLLAAFSWASEPFSTSQSALENVPRSPREALENRLGVRAASPSGAFTNYFAVKATPTPAILEILREEGLGADCSSLAELLLAEAAGFRGERIFFTSNDTPLEEFLKARDLGAIINLDDASHLDFLHEKLGGALPSILCFRFNPSAESRQATVQSNPMIMGRPEESKFGMTKTQLFRCISRARAWGVCRFALHAMILSNSLSVDEVVETARLLLTVAAEIKERLGTTIEMINLGGGFGVPYRPEEKDLDLHEVSARIRTWYKCTLALQGLAGTRIVTENGRLITADAGVLVTRVIHQKKTYKRFVGVDACMAHLMRPGMYGAYHHISVVPDRDRHDPRLPSRRNLFFSPDDEDEEAGVSDDAIYDVVGGLCENNDKFAVDRPLPRVDIGDLLLIHDVGAHGHSMCFNYNGRLRCAEYLRRLNGEVVMIRRAETLNDLFATIQEPSLPCGLSLLFATNHYEASTCAVSLPTLPHCFFWRLASSLSSSWWTRRLTSQASSPSAVLLWRRSCFVAILAGAAALATFSCLFSLRIARRR

SEQ ID NO: 859 - protein, 307 aa, Neospora caninum
MAAQLPDPYAAQYAPVSSAANEPTRPAVLISSGTPAGPSVGMPSAAATVPSAFGAGPASAATGMVYVTSAQGLPSAGVAPSAAGSFTYPPQAVLPGGSFFMSSAPVTVIHDNQPPALLPALPPSFRAGWLGSRLADASSEDLPGVRTLRGGIVTCIMVLLVSSLFACLGRADFNFVLYLVGYHLWCVDGETKSVTGVKRLLRGARQYAVLLCIASVVEITWLFIAYSTWSCEKGDAELCFPESENLRVRWTYGIHNWALGLSTFNLLVKLFLIFLSFTWVQRQRTTLGLGGAGPVPGGTSILPPGSD

SEQ ID NO: 860 - protein, 574 aa, Neospora caninum
MEKILWAAAAVIAAHLASTFTAQVYAKDLKDPSEPQETGNPFLTRVQGSFLTNLHSDDAAVFRVASAEPTETEQKAPAAAGNERLEVKPFSAKSRDGSASVPSFELHAFNPLEAVVQEPKEMLVNMYRRLGGKVKKKDLVGELLQRLSKAVFPLFRRLPFWGEPPAVFNKHPGHIEGGREAVGRVLEKMGGRPVPPVYEDARHRVMLQTSMGILQRYSPLVMNSMSGEREVTFRVEDYRPVPGWGVGVGVVHQETNQEFLLISVITLADAAWGSRLEWKLRHIAKPLQTLGLRDPREAFLHDRLLLPLDLLEISRSKSYFVTNRFVVPNLFVLMPKPVASLSNIMLFISATNDVRGTLAVRLSLTCQTIRVVAGFNNRGFVHADLRPASFLVSAQGVVFLGIFNRAVAAKRGTRVSKGEPFDVTTAPELFHKQTKPFSQPDRKTDAWALGVTIYYIWCNRFPFGLQDGDSKPPPALLEGVPPDFSFCVQHMPDIVKVLIGRLLDRQRITRFTASEVLLSGAFRHLQELLRASESSALFRTPKAAARWEDLKQRGLRRRHRSRPYKAGLRRSPPT

SEQ ID NO: 861 - protein, 665 aa, Neospora caninum
MGNALLPFLCYHTRGFFARDGVYRDPTSRFPYLSLCFTEPVLHATIVYLASIALFLLHPLLFGTAPPFSRSSSAAPRFLLDALAVLPECTGTFALTAVAFFAYLPAYLLAAYAPLQILFASASKLLLPPRLQLCPCLAGFTHAVFFALLLFVWFRLLRRLAAGFRLPAKPPSSAGFCRFLCPTALKTCLLCPFLSSTAVVPSPPGPSAPGGAAPRTFSSFRKFAASFSTRAVVASAFPPLPKSHPRQPFLPLAGRQVVVTGGGSGIGSETARRLALWGAHVLIGCRNVDDGKRLAERVQAEVAALQVSWTMSEHPGKISVAFLDLCAFPSVRSFAAFALHTFQNSIDILVNNAGVMMISELTVVDECGGFEKQFVTNHLGHFLLTLLLLPAIKRAAQADSPQASTASVFAPRRLGRIINVASCAHVWHAKNFRALDASCTPDGASVAADALGKPLEALQGCPPVSPLSYDKRKAYGNSKLANIWFTKELQRRLIAERGEAATQPEEEKEEKGEEGSGDGSEKRAEKAGEESASCCVASSRNAKTGDSAVCRSEPLPEGTVGVYAVHPGSVSTKLTRHMVQDRPFHRFFVESFLAQTVMKTATDGAATQLLLCLADDSVLLPGAFYADGGPSWVHPAANDEERMKELWAVSEVICFGGIGQQTYVK

SEQ ID NO: 862 - protein, 658 aa, Neospora caninum
MAGSCTDLVVLVGQHIRAILERVPGAKVLLLDQETTGIVSTAVSQSDILQKEVFLVDRIDALPRGRFEHLSCVCFLRPTNENLLLLLQLLHQQSRRPNAGGDAQNGVPLTEDPSRRQPDPVARFKDIYLFFTSSVHQQPQLLQRLAKQDEADKIVQVEEFYVDLYALDPHVFTLNILAIAPLHAQDLSLWTPYEESLFQRMLDGLFSCVALLRIFPLVRFQSNSVVSKRLAAAIQMRLSENADLLDKRPQGSLPGRAADASAGSSSNGGSRLILLIVDRREDPVTPLLNQWTYRAMLHELIGIQNNRVDMRRIPGTTEDLLDIVMSPMQDKFYRDNLDSNFGDLGLNVQKYVREYQSKTESTGQLESVEDMQRFVDAYPEVRKLAGNVSKHVAVIHALSKIVSDRALLDVSSLEQEIACKEARSDHFAQVADVIRNDRISNMDKLRLVLLVALRYEGDPRIHELTEGLRRAGIEEEEILLVRAMTQYAGRHARSADLFSNRNFLAVAKNTIQRGLKGTSNVYTQHRSLLWFTVESLIRGRLSTDHYPVSPPVEYGAAASAPHLLQPSREKPQTVVVFMVGGTTFEEARDMAELSKQTGCTILLGGSTVHNSRSFLADLSQLIKGQGLQVLPPLASSWRGRAQDGDLRRGAGVELQGIS

SEQ ID NO: 863 - protein, 361 aa, Neospora caninum
MSLSSASPISRGARSLQSRLSFKRGDFSSPSCLAKANGFAKRALNPYAFSSLSLGVSSHARVCAALASSASPLRHAALGAVSSPFALRAKEARALTTRAAGAPHAAPDPATEDGVSPSGDSGASRGSPGSVSRADEEEGTVERRKRSNEEGKREQDEAERSEGAEGADEDAPAVEEKYRQCLEEVENLKKKNRELQDKALRAFADMENARMRHQKEMASLKEYAVSDFAKAMLDVADAMAYATNSLHEAVQSDSSLLAGQEANGAVDLVALKERLQQIYDGVKLTENLLHKTFDRFGVEQFDPAGEKFNPALHEALFELEHPNKAKGEVAQVIQKGYKIKDRVLRAAKVGVAKGAPNATSA

SEQ ID NO: 864 - protein, 703 aa, Neospora caninum
MALNAVAPVSPLATESAPVVGAADGQTASLPVSPVAALSHGSTPPSPSATGPRETVPKAEDSPAGSKAGSRRPSFLGLRKHRADQGNETENGEETRHSRRNSFATKAKALLGKSKKTDATSVNEETDSYVGGTAEANEEKIEMTRSPKAESRTDKWRRRLSLSRDRSVELIAGTEDGALGCRAPGSEPASPKNDASESRLGRLKRRLSLSKDGDRSRRPSHVGEAEIAARENAPEKETETANGPEASPVQVSRVAKEEAASEPKATLEGSEANTAEASPTNGKSESRVDRWKRRLSLSRDCSVERNDKGENIPKSPVAEEESNARRFLHRLSISSRDEKRNSDSEREGEAKEGRMSRLRRRLSISKKDKKSEEQEQGERSEVEKESRGRRILRRLSVSSRKSAQEEGEGANTQESTSSKLRRRLSLSSRASRASREGSICSNDGEDKKEGNTWRRRLSLRSRSREPPLPCPAGQQTRKSLKEKVKGLVKRRNSRAEDMERVEQLHNPDYKPGTHKIEFESSEEESEKEDEVFDMEPSQGAGNLTEGFAVSSESSPVASSHPETEAANHFPVDEHVSETVTRLETPKDFDDWMHSAADVDAGIHLAPDDTEETSRTVHTPRAERKEDDSMFGMFCCGVEGKETADERQRWKEALRYSCSKMRPQEKIFMQQPLVCRELGFDDFESGHKLCYAPTEYSLEIEKAF

SEQ ID NO: 865 - protein, 719 aa, Neospora caninum
MFVCRLCRSISTIAAELPVADGTPLRVAKKLFLTSCLLKTFRCNHGGGAKSAAVLCRASVRTPHLLPLVALRASFLSSFGSIVTTAKASRMRAKKEGCSGSASQSHKGLSSDRILSRPTTAYQDQKPGTSGLRKKTKVFMQKDYLANFAQSVFDCLPEEEKKGGTLLVSGDGRYFSHEAIYEICAIAAGNGVGRVWIGLNGLASTPACSAIIRGRENGVCFGGFLLTASHNPGGIDEDFGVKYDTGNGAPGNEVLMNQVWEKSKKLATIKYAELPKFSLDKLGVQVNLDGAFQVEVIDPIEDWMHLMKEAFHFPAIRRLLALPYFSFVYDAMHGVSGPYAEKLFLEELGAKPESLMRQVPLPDFGGHHPDPNLTYAAELVAKMKVFHPDQIDASTPLFGAAGDGDCDRNMILGRGFFVTPSDSVALIALYAEKCLPFFFVDKATGKGGLTGLARSMPTSRALDNVAKKLNKDVYETPTGWKYFTNLMDANRISICGEESFGTGSVHVREKDGLWAILCWLSILAYRNGCMADVERERAAAKADKPVDVSPPATKEDFVSVQRIVEEFWKEYGRNFYCRYDFENKDSTAAHQMMHDLEELSKSSPTEIVAKVASHVDEKLLKEMEIESMDWFKYTDPVDQQVSDHQGVRLFLKGGSRIIWRLSGTGSTGATIRVYMERYESDSSKVLQDERTALKDIATFALQFCDMKKYIGTEEPTVIT

SEQ ID NO: 866 - protein, 779 aa, Neospora caninum
MRNTGSLGRGRGYVDAANLPRLSKEPNTLLRKVVLYRGDITELNVDVIVNAANPSLLGGGGVDGAIHRKAGPELRAFNQTLGGCKTSEVKASPAFQLCCKQIFHTVGPRGEQPQALRACYQNALELLKKSKFRTIAFPCISTGIYGYPQLNAAQVVTDCVTKWLKVPANFEAVDFIVFCVFERQDFVFYEQLLAKVKCRAPVSIASAFAPPTSEDEPASVAPLQARLVTAAPDCVPAVHGEPPEPRAEASRAEERMGNAGDGSVPAEDPGEDPKPWGGSWVLCGGGEDATREEEDGIGDEDDRTRVFAYRGTQEGMELQPLKRPTGPEDSPCGSSTRRERRGRRAEEASRAGDTGTTRGQQARRESALEAREGGNRQKRRASVDEDSSEDDLSDECPAVRLVEKQERRGERRRRNERKDRRGQPERPTKKETKRRNSDCFDRHLQERVDAEERLKLATDYSSVSPSPSGVPQSCGAGHSSPPQSAGGSPRQALAAQLHSAARDAESLSESAKTVEIISGGVDENPAAAAVPVADARRQEPALEPATPSSRDTGQEAKLASTRGSGFRSPNAFPLTASAGAAPSPRCAEALPEGSPAETAAGASPKSGNKSAPAAAKRHKKPQSAEEKKKACSPPEGKRKTKQASRRDSQNSQESPKASATTAQPPDRTASLGEELSGAPGNRGALNDGEESHWSVTRLELPPVNPLAEGPLVGNQNCPLQSADVSSGCTAPRASSGETEERSKRPLSSVTPRSSGSRGGARRARKQRHRKQQAKGRRNT

SEQ ID NO: 867 - protein, 792 aa, Neospora caninum
MSSDSSLPSQHGYLASAPPTQEGTRPAGVPDAATKASNGHSFSSASPWEGGDAEESPSAGKGESKRAFAPAEGVDSAKRLRVDAGQSEPQEDFPLPPEAMRPFAPIDLAKAGGASVLHCTPDASLLSPLPKNADAGASRPSSGDATRGTSPLGVEEEETDRGATGQGSGGGTAPSGAMGRRGENKPVEVAPNVTRLPPYDKNVTSSILVSKATFDTVSLPSEEFRERLEAPLSGAVKEEETEKDKESEGESLLGLPDRPPVPLDEAKLREREEEAWRLAQQKEGREPYKLPSCSAWFDETKIGAIEQDLLPTLFVDSALTASEREERYFQLRQAIVSLYRSDPTKYLSFSECRRAIAADAALLLRVHSFLDYWGVINFQADPATIPSAVARRKDLLLKDIQAVQKSGEASRLPGDNADAASGKSPASLAGSSSCSLDDSPATGGAGPWRCAACGKICLYSYYVLRPGGSPGISLGVLDKCVWCLKCFADGRYPPVLTERNFLKVGLPLLGSDGKDGKWTLEETERLIEGIERYLNDWNEVAAFVGGGRTAQMCVERFIQLPIQEPLPSRSAGEDAGPFLHFKNPLLSLLAFLASTVHPSIAAAAARAALQEAVDLLGDKETPTETGETGETEGEWAGGGREANGVEKSRARVAAKKEDGEAESRSAAEKAKETEKEKKEKINERPWQANPENKGLIADRDLQAACATALAAGATEARTLAKVEEKEIGELMSEIVKLQLEKLELRMHKMQILQSRIARSKTAMENKFAQLLNEHKDLAAELAKTKEAALAAL

SEQ ID NO: 868 - protein, 391 aa, Neospora caninum
MFAANRVVRGLSSIPLIIVTGIFVFVWICYVYIYLHLQLAVRESNTQLAAVLGVFGTALWLLALWCFYACALRDPGEVSDAWRADATAKKIPFIKLDGTVSQEGGDSLTGDSEAPRTRPRRIRDFHAGYATTCAHCANGLRPERAHHCSICNKCVMRMDHHCPWVGNCVGFNNYKQFLLFNLYCALVCTFLGASSAPWIVNEFLFTSHSSRSQSLSPGVWGVFLISWVMQVTFGVVTLVMFLTHLYYVLVNMTTIEVQYPSANPYNVGRLANMQQIFGKFDGSWFLPVAPRQPVCSGDVFPYRVDAHSPPGGETAVPSVNSTIPVGLRDFATAPTTSVEDLGASNEAEDANGQAHAGNGVEAGKHEGEGAIPTCREIPADAHAAVPVDAQV

SEQ ID NO: 869 - protein, 415 aa, Neospora caninum
MPSGSAAVDSGATPALTRRRNSKQETGAGLSSPMSRISTTSGQDEFHSKGDSPVAEAKATGVDGTSVRQVLLMIVIVTGIYFFFLMFGYYQEQIYHQVDPTTGKRFSFSFFLVFVICASNSFFSLGLLLLQTRGNAKKAFHVLDAFILREVLFISLSYSGAMLCTNYALTHVNYPTQVLVKSAKMVPIVLGGFFVFRKTYPWYDYLSVAVVTVSLVLFNFAKAGGSSKQTESTAVGILLLCVSLFCDGLTGPRQDRLMARYTNLGPVLMMFLTNLFSTVWTGIASALIEGEQPFIFLKHDPDALGSFAAFTVSGSLGQLFIYQSLRAFGSLYTSLFTTLRKATSTVLSVYIFGHRLTPVQWASMFSIFLTLLIQSYCSKKFKKHGKGHRHHGHPHGHKEPQSPSGLGKETLKKQS

SEQ ID NO: 870 - protein, 895 aa, Neospora caninum
MDGVALAGRYPAFVERVLAALADGAAGRSEAALASAMHAIDECSTSHDKALVLVAVVEEKLRLSTDGMLMLAGIELVAMAVSNLGVDFARCLDERYMKTMTKILKMTTLKKSLSRDVKSKINKFLNGSQSCNPGVATDPQLHRLKRKVLYLLQLWHDSFVLQQERLPAIFEAYRKLRAKGVEFPTVDVNMKFMVKNAEAGRHSSASTIVAVGRRVAAGAVATRSFSSSKSNDPRSLELLDLDSTSLHSSQSSSQSSSQSSSQSSSQSPFSSGGGLDALDAIFRTACVPEVGKPNQAALGSAPGGSSEVASFDSLFAINALAVAAPAQAPSHSASCHPEAAQPVRRADAAASCRDPRRFDAFNDLLPEPAPPGPSLALASHAALPQPLGASPTDCGDARTPAVGPLTSAVRPRVSSGLKGPCAARPLHASETGARDSKEESEEQKREEKREKDPFSKDSDERRTGFEAWTYPGQQDDSSRAENHAENAIPAFPQGLKEGNGEEAHADASWRAFPPQSPNAFGNPSSSLSSPPSLSPGAFPCPSSSSSSTSFSSTPFPSSVPFSSSIPSSSSIPFSSSVPFSSSVPFASAPSSFDPFAEISCAATPGEVEGTVLRKERENPAPSVAFLPSPPSSSAPWAFPPLPTEAPAGSKGTLSLSFPPPPSSSSSSSSSSSSSSSSSSSSSSSSSASSFSSSSASPSPFVPESHEGVEGREVCAFPGSEEGRADDQWQWDPWASCGREKELFGSSSGENALVPSPSEAPAQLSFPEEPEVREEAKEKLERIHNEKEENQAEKQREKEENQDEKEARQIEREEKQEQKFPEVNGVSQSSEPSPFFPSDTAKNGEKETDQEAADSRQAENSEKESEGSLEHGEHALLEELELQLDEMTQSFTVFDF

SEQ ID NO: 871 - protein, 450 aa, Neospora caninum
MDLSGRVPAGLTRNDVARGRATQLVRPATGTSVNSLRRMPDDALKVSAQKAKQMQKANIRVEEETRAKDPTAATIQALVLEMREAMQQLTCRNRRLEEELRRYRASFKSAMEQQERFARNFHDCQAELHKERQRSEFQEREFRTLCAQLTTTIQGFAADHEEIANVCSPPYCMGGKGLRELHGLAQILRVKLALGVYAHLRADKAGAETRNQEQERLSSCILAHNTAHATNETMPVMTVGQVRPASGDQSGRLSPTEPLRHPCSPSPAVCGAIRGGGVALGKRVSINLDTQDVCPPSRLSSHSSRSSFNAPQPGDEHEAGSGFTAVSARIHEPGSRESTESARAEQDFARTQNGGGIEGDKTRPHIAEPPCENVECGNDCLSDSSSVSERTSDSEFLSSSSGSSPRLSHRAPPPPKSLRPKFVPSLSTAAAGTGSWMSGNREPSEYPQGM

SEQ ID NO: 872 - protein, 944 aa, Neospora caninum
MLIWHRDRFAALPAENKNGNAYVGAASPEKIEMGECSNASTYYGSSDGTSSQDEAQRSDGGLDGTRQEDSSPASFVERTRPADPASPASIRGRRDNAASSVSSLATMLPTAPPASPSGGHAPPASGVGVDPRLANHGASSRAVVLGLLHDLLQALPTANIDQVLASLEPIRRHSGSGGGGLTDTVRLSQLSEASHGNPASSDDFLQRRGSNEECGVELGTAGGNGQRESARPSSVPPKGQRERSSATSVKSADSEAGARRRSSVSSASDREGKAAVASCWRPGRKDGGVGNLPPLPSSLSRSRRPSRGEATPQGRRVGAPKCYETRPVADCLQSRLVSFGRRQKSDEEGTRSPRGSVSQRSLCESKRGAAGEGATKKKSAVQGQNDGAVKKDNRKAKGQPEGNSGNGDDRLPSAGTAPMTAKEIVEKHAEDLREWLGWAVSLGYVPGLYSSAAAQMGTGDRFANSAARHPFLVHLASPNANQGPQDASPGPLGLPFQQVAGVECGPAGDVLSAGLPAAAGARVGAPRRNLGASDASADMGRAQPPNATASSPGKGQVNTVHAEADVSQGLRAARSRSILETLTADREGNASPHSQLPRPKETTALRLQARGVARPVPLFLAAAEASGTEQASSRSDDDSSGPQVTTPLPPIEEEGEDIDVISLPQKLMPVTPKHLLQTPRPAWLKGTPTAAQAAAECRAASAALRQAALEELSRTTPTARDGQNPEARAGDAEDVSPRQHLEETGKTNNACWSGMGFKACGARCATGEPEDSEGSDDASTPRPVPASAVTLEELFPQIKSQRQSCIANFWKLLCSSPGSGTVFSRQPGPLPHHKAPDVFLFFDPGQPGMAPLSRVPPHDYLSRVDGARAHIPHPAEEPYPFVAAPCHPVGFPLTPSYVPLNGNGVLLPADYRIAPFYAYGGPAGADKFIPPASTLAPVHEGATA

SEQ ID NO: 873 - protein, 918 aa, Neospora caninum
MNSAEPLLNRTPFRLLLLSSIAVGTAAALYLLFRPRKSRSRWRERACLSSALGTGASAGAAEAEDDEETETACKETLFVYFGSQSGTAEAFSEELASAVAEEIHELRNVEVVDLEDFDPHAFLAQKYKVLVVATYGEGEPTDNARTFFEWLKAYTKSLKEGSAPSSPMRGWCAVFGLGSSEYERFNRSGRRAFKMLDYIAKRQQELHAPSRSLLRLMCPLGLGDGAKDSDVDFADWRQEHFVPALKQIVKTNSLVKGEATEAAQGDFACATPSSGGFEETGRQTREDFARRLLQGDTATRTGGNQEGNENAHASGLSTQTTSSPELTAAAVDRLQKRVEAWARRGTDAAFRLRVGPSREALLAEQRRVEDEAARKAGKPPASLTQVPNGTSAKAFFHMHAFPVKRIRQLRQQITFSSSCAGTLSASSPEGRTQKREADTWRQTAPEESTVEVELDLTDLPSVQYRAADNMYCLHKSAPEEIAWWHTFLGFKDQGVALSDYVHWLPSPDALASALASSSLTYGVPFPTPCTVEEALGCFCNLTGLHPKFGASCLSLWIDDPEERTQWLRLFCDDAAAQHVYEACVKAPLLSLRDLLPTLAPSFRRPWVPRLASSSPSARLPSVSVFAENRTEPDEDRELGVLLSLLAAAHAPRAYTTASSPKALASDAGMRSLSLCVGLVAEQREGLGRTTARLEENGFKIFGASSAVRSERRGPLFQQEGRPFFGACSSFITQQLRPGDEVKALIKPSSFRLPADVRVPVIMVGAGTGIAPFIAFLREFECIGGWGAPVVLFFGCQRENKDFLYRDELLRYRDQASARTASSQGQKHILTHLFVAFSREPGKPKTYVQDQIAEQKDLVFQLIQQNATVYICGRTAMAAGVTETLARVAAEKFGGDEARARDFVHNLRKSKRIVEEVWA

SEQ ID NO: 874 - protein, 520 aa, Neospora caninum
MAPPLAEQDCLPRGSGRGCLSGDSEATPSPQFSLENPHLLTAVCQVLKRIDKQGTGLTTAERFNAALSDMGVKYGTPEADMIMRYCQVTDDGYVIFKELMLATRPFPNVFEDHITESLASATNREQDRLVPLPRLASCQRDVARDGDDSLGVDSEQMGDDDHGVYTPELTDAIRRLYAQWDRSCLRDWQFKEAIQRLGVCVTPEFERLISTYGPSGSVAFSQVMQTLMMGDSGFLASCSLRRSRSRHPGDIPLPPVADRIPFYEPRRNPVTWSPPQPLRGVPVNPQDVRHLALNLPLAAGLQGRSSSERGAAATDGEDASSLPEKFHFLKKLVALYLADRLSATQLRKELVEVDVPITQELDALIRAHEADNSGQFTPFAVAVFRAAEESEIYRKEMRKVSAGADAEAHAARETPYVVVDKLTQVGELAHRVAETIPTQIDEGDIEASAQELREAGVKYPSETEMYTRETASKFEDDPKGIYVPSDYGAAQHATLALANRATAHHAYYGHGNIITWGKTY

SEQ ID NO: 875 - protein, 603 aa, Neospora caninum
MDASTTACSYSSHLPFPFPFFGSAVKAALLVMKHVGGKIMLFASYPPTIGELVTKRSGGLAGADGTGSEGGSRQQPDREVELLKPATEVYQQFAQQLTQSQVSVDLFIAPSSCASPSSCGNVPANGAYGAKAGGSAPGVVSSPYCDLATILPLAELTGGEVRYYSAFNRLQHGQQLENDIVHIITRTTGWEAVMRIRVSRGWRIAARHGRFFLRGTDLFVLPTVNADSTFSILMELDDQSSGPGNSLVAPPTGSDNVIAVQAALLYTNSDGERRIRVHTFCMPVSQNIQDIVSSMDPEVVTCLLIQQAIDQSLRSKIADGRAFLQTSCAQLLSVLHTVGSSPQVATGYSLPSLPHYGAVAAASTGNPAGGALMEAGRLVALFILGVLKSNAFRHVKEVSTDQRVFSWSRLLALPVDRICAYVHPRMLPLHNLSNFGGPHDQVLDGQEEVILPPALRLTAEEMTQDGAYLLENGEEMLLWIGRSISPHWLSCVFGAHSLDCVHPDVAAAAIGDTQDPLGLRVRAVIQSLQGERLCNAMRLLVIRQGDPSEQKFFAQLMEDRVPSLLLTFAEFLQKVDVRSQLQAPAPPMIPAGAPPPSQQPRMY

SEQ ID NO: 876 - protein, 1217 aa, Neospora caninum
MDFAGTPPVDEEADPTNCLSEVAETVGRGDPAEPSHAEEQGGAAPEEKGEDALEAEGAATAESREPGQGGEERGPWAHIFRRGGAERRRGAPRGGSHPYARRQRGDGSGHVNRRRSDRDLPPWSQSRGPSGGRGRAGGSRDPREGREAPLSVKEKRWVCVRTLFVTIGDDVALIPQQIQKLARESENAIVQEREEDREREERKLKLKQQAERRDVDGDFGAIDELKNPGDAGHREELDADGAVESQGDSANRGNAAGAEEKNEQNLEDRLVELLVDCASLLPLKVGIYSCVVGLWFKKTRLRPLCLRIVERSFERFEEAVKKGNFLDAKLLLRFFVALAGSFVVSAAALPWLSSRSWETHRRAVEELLALAHQMSPASPEALLLRHATLPIRVSAGGVLGGDEADSAILASLGLDKNRVQSLLEALGSMEQVQWKSKATLRFYQSADLFPLLKPPSEAAAALAPACSLPALTLTLDDLRQIRALPVASVIRLPVSIEKVDVPLSPHDRWILEDHFLTILHNFRDNVTLCAEALLRVPVDHDQFDYVLVECLFSAMLRLPRAPLATDVEDTSFFVTRVFQRVCQMQNSLVGVVEAGLTSLLKHAAHLDFQSMRVLADFFAYWLNLWEGRMSLLEDWLSLSIPPACVKVFVRHAFEKAFRFRYRPNLLELLPDCVLPYIPPEPTPACPYTAEPPQQNLPLPGAPPPPPAAELPLTVTSYPGHLEFLEVQKLLLFSFRKREGAGPTHARALGAGGRGVRDGGAARRPARGDADEETEEDSKPDGEEGHEEGGDGAMNEAHDDEEAGQGGEGEKEREETEGGKRDWMQYGLARLLRSRLHHKTWRKRDPHAFSSSDSAEDHDAAVDASKRGTGEDQDGEEEPKASKGGEGEAFREGAFPYEDDDDGHVWSLTDLAQVLVFALLARGLKTLTHSERLVENYFPVFRFLKEGATQKALREMQPAALKARGDTREECGEESDVEMDDEEEDEDPADEEGLTKAERRAQEVEEAFLKAVFDFWKHSRQKTVLTVRHFERFGVVSKEGVIRFVFESLSPGDRDDSRVMELFDLLAQLSIQDFDVKKETALQLKDACGEDAEKIAEAAQAATAAAEALEGVHTLLHFILIGFMRELLREEQDARRLTLRARLLYLARDYGKFIDVPRLQGQIGDSMTDELNQLLTVSSQVQTQIFFLDREPGGLLGPLGDLEETREAFHAKGGENGV

SEQ ID NO: 877 - protein, 1433 aa, Neospora caninum
MAELSTTWQPRLLLQSFCSNAATVSSLSLSTPPPSVAEREARGEVLFSLCGGSLFAVALDAAVRSSSADKTNGAEERARDPGVHTPEEAGPLTAPAFLRNPFAAPQRLIDEEVEEGLAAFAAADLSFSSSPPPLHASSSARREGLLVTAGASTGLVRCFRVYVQPRQGTPEEEDETADASRGLQLLRAMQQRTGEGKENAVASPVLLNGENGSGSWLKMEELVKWKSPSAVTRLIVVSAPFAPPFLLSRARKAVCRCVAMGCADGTVECALFLFFQGEKKENEEGEEDGRPAQLQVVQRCFVDRLSGEAVSSMKFHSSRLLLAVGGERGSLRLIDLCPSVLASLCAVAGRPEAHSSRRSSVYTLADHMSAINSLAFVDADAAAKKHTAGDASERRPRATPVAHLVSAGGDKLINFWNLDRLPESAGDLEATAVELGGRKGDGKRKELSKKAHMTADDELTPAFQFPTSELITAMVYVHPRMEEGESVDRKTQFRDKKEERGVLIVGGEQGTLFVLSLQLRKFIRSLPLPTRSAAAVAASLAGSSAPSPASSQRQLEDFNAVVRSLTLLSRDGTVHVLAAQESGAIALLPLALFFSAHSLPSPALRKQALASSAFFIGRMDGILGTKFLPQPPACDCPCCRARRDTLSLGEARIGRGKRKREDALEEDEDSPLAPSFPRSLVALVGERQPWVLRLDGPAGEGHPVGWTAESTEESADDQKGEFPGSRLTEAHEAPAACCDVSRKGCWVLSGASDGSIAVWHVATGNCLARVPPGHHGGAINAVAFQQKEWLRPSPLFKKGAPVDVAADSSRKDKRGDSSGSAVCSCDCRGINSSTPHSLLFAAASSGDHAVKVWKAEISPAFLSQTRGKRRETDGASAKRKDADNAKCSAPQLLVTSLASVVAHRKEINDVKISPNDSLLCTVSQDKTGKLFAFPSLVYIGELRGHTRSIFACAFPKREKIVATASADSTVKLWNVDTCACIKTFQSTVGGGILALSFLSRDTQLVTGTSEGLLQLWNCRTAECIWCLDVCGPAMVTGGSGGQLCLWEDITKLARRKAELAQQRETQQLAALKLLAAEGRGDEVFSLLLRLRRKAGMREFLETQSGKVLLEAFQRGLDLQRQIVLHAGRPLALSGSDRDVSTSTFGRFTSFLESLEEEREARGAGAGEGETHSARAKKRKNGGVKREESEAGNGKKRDGTPLRSAWLCGLDGELSLLDLLRNMKKKDVETLLEFAADWNTNSHSAWLAQGLVNLLLEVRGADILGDAAKGRQRDFDVQNVISSFCAYTERHDRRLTALIEKTFLLDLLQGCEAVGESDSRRERERREKTQNLTPEDATTFTRLCLYGEENEQTEMPRSERKTKAVAAEEGASQGVVEEEDEEEEEEDEGEEEEEGEGGDGEETEEEDEAEGEEDGDSEEEESESQEEAEEEEDE

SEQ ID NO: 878 - protein, 713 aa, Neospora caninum
MPAPCVQASLLHSPEARQILNASLRESLVEDPYFPLFQCPASSCLLPSLAAPAFASSSPQLFCVDQEGHACVVDWEGDFRERIEVPCSLESGASEAEAPGGTIRLKKAREDASPEHSDHTDAYVYEIAFPAVPSYRHPSPVSVSGTLRPVKRSWSVVRVKQEDGDSASFSTAASSHVVAGWQLAGPVNCATPIHPLMPDRFAFGGKENDIKVFDISQGRYIWAAKNVRQTLLQLRVAVHPTSLAWLSSIHPLLLAAGTAKGAVRLFDLRCQRRPVYELENAVRGTHDVIEKRVISAMAGEDVHTADPNGLWSILKAACSGDRFGASTLEKPDAQQTRNGAFLASNKVKKEAHARRDSEHAEKDANEAAYHGRDEKKRRKTAEGKGGRDKSGTLSAADVPVATEKNGDCCPQQEGTTALTPSFGEALKAQVRRLYGRQKANLYFADSYGAVYVHTVLTEDALMRYIDGAVKKHNKTSCCTTLSEEEENGDHQRTGKKRRWEDPRIRSKLLLAFQERQQRKLSSKKNASRLCTSPLNGPQYTTVFAGGFQGAVGAILALAEDVTGRCLVGVGYGRHAYVWRRSSRKLIEKVYLKQKLLAVLPSRKAVAGEEKKRGSETESEDSGASDGSEASSEEVDNEESGDEEAKVEGEDDDSENGQDDEEEENAEDGSGEDEDADSGEDDEDDSGEEDEDDSGEDEEDDSGEEEEDDSGEED

SEQ ID NO: 879 - protein, 717 aa, Neospora caninum
MRRPRSRAPSALGASLGFCLVLALLFALGIRAQSQEAEDGLDLFTESVYLQGLKTQGYFVAHFDFRFKTRFPLSAETGATRHQHYDIFPKEIGKLLTLHLQSSLPSPSLAAAPPLLFFDASLTQGRWLEAAWGVAPTAIRPPGAVLRAALSSNPVYDSQRTWSLLTHALGGIMCTAFSMLKNEEMAYTLAPSSFSHVFEDKNSESEEKAWTLRVATSPVEVACTENLNSLQKLLPCRGEAGLLSRVHPLAFASSPFKSVRFLAFTEAEENSLSSAFLRAELRALLTVVLPIPRDGEARFTLPELFSQRGRPGASPPPLLHCVASSSRVLVRLPRPGVPEHGDTEDAEDAGEQRDTKHSLQRNARETARVAAAEAAVASTGASRFNLYSVDAFSDLIVFDAFPSREAPDLPRKDPLFAKEILRAPSDGEGLLSGRLDVERQQTGRGTASSKLERMEGAWLLVFRNRHAFGQRSVRYFDNFPPFLFPLLHTARVSWKSLPRKATSSRKSGRRGEDGQDNLCQRAFSPVAKQLHLTGAQAARTLNLRLLASSSSFIENPAPTFLSLAFALPPRCQIEFSVGVEKRYWPASRFSFSPDKGSDVPGAIVLDMPSYLFSWPPPPAVLDAPLACNVGSACAASLLISDAAKGKAGKEAPLSLEVAAEGLYAPGQRDSWNWQITEGMIVHLPLPDFSMPFNVIALSGTVLTLFYGSVFRITTMEW

SEQ ID NO: 880 - protein, 1670 aa, Neospora caninum
MTGSPPPSAPEEVEAATAFLAQRGVLPRRSRRTDRPLASSNASSSPAPSSGRSEGEEETVHGAEAACVASDAGSREEGEDRKQSEETKRGEMPENAATGILENLLSAVAYGLLDVPRWKRKDQQQLILRFFVPRVEDETGEEREEHERAEEDDEGEEEGEETDQGGEGVFSALTIFSAFHRFLLAWPRLAASPWFLGTCRQALKQTREDTRDSQRMEEDNAFFYHPSWRSWTIILQLLEVFVYTPSTLPALLSCLSSSPASPSSKSMSTSPVRDSAVFQNLLSLPSLVEGALCALPGGSAAVSCLLPSSVSSSVFAFRLGEALLVTWRRLLPQRDVTPSLCWRNCERRHGKEERGTHDGRDQETANGTRTTRAAEEPETQREALARETQKTGEQERNQAREHDSRDSQEWGKSEGKAEVGRACGNQDVWGKALKPLLAATRRFVLRGHASSLARAFVVALLSPDEEEREERERKQTGRQKVKATRREAQHEVEERSERTEAWGTRDKRGTKTKEEEQEEEEKEEKTDVCCVAQFMASELSREDAGGQAAHVFVFACIREVVPLFFLSSHSFGPDVSYLQEGNEPILSFHSPAAPRFLQSLLLGFLHASPFSPHGRGVASGFLSQFLFKTLDPSSSHLLPLPTALFLLDLLSGSFQPLRPLPSFSSFSGDEAAVKPGGADGASCFFCPFFALSFLDLLQHFLHLWANQDSSLVSLSAHQHLLLTCFVSRSLSNVTRLERHLAALASSRASSVASCQSGECSDTRCAKSVLAEEEARSLELLRFRLSAFSTGKRFASLMRGIHARLGSSEEALRLLGMLIAEKMAKETLRVLGRKGKATPKERLRPGQADEVAHRKSEAETEDTGALAFRELRDPCVVSRHPTLFLFFSASESGEWSTTRRSELANPSEEEEVSRRTLHASCECEKRGDTGDERAKSGDAERERLARLPVGETDEDVRRLEDIADCLEAKRRSRGRSGLSQLASAFALLDRLRGPAQGAYSLLCGESAVGRTGAETEELANAETEENKTQEGSGQESPGKSRSDSDRSTPGSSGPSSKLPTSSVPSASSSVPSASRFVGEAKASFAEPREEKKPVHSIPIVSVDEDSDSDEDEDDHYFQTLPDLPAFDASSSSPSSSSSSSSSFSSSSSSSSSSSFSSSSSSSSFSSSSSSSSFSSSSSSSSSSSSSFPSSSAPRFVLPAPPAGAPNLPQSVRQVVEWLAGEMHVTDEASSQLVSVGPCSQPSGQNELPSHRLFRVSAALHSCPLLLLLQAKGDSSATVFSLTHGRMLGEEGIASPSWEFRDGRLAPRLLRLLLCVETSIGAQPAELERLRQTSLAALIALQLSPLLPVLAVTLLDSQTSAHQKLLVLDALQRAAAWLATGAPRNWALLSPVCSEDGEPDEEIAGGEGKGGEGEQRALGETGESRASRTRRFAHSSTARKASVNLFMPHASSVCTQLLSLLEVPAYPASDFAAQQSYAQRVVCHKRLLGQPTVVASLLHTAGVSVQLAGRASLDAEEFAAAALRAAVGFKGHCDRSVRRGALSLLAAVTATAGSLDALFRSVEYAERNLGCTYTPTESLRGALEGSASAGSDGGREGTGFERSQFFPDEDSWLREDSEGFLLRERQVYVVGAAAQGGLGVVEWLKKQMLDDPDEVCRRLASLVLSLWLELPA

SEQ ID NO: 881 - protein, 1938 aa, Neospora caninum
MGNEVASHHGAPASPSHAFKARDRSGDGTNDRQRHPEGDFSPEAKTLGGFRQLLARRNPPSCAARPSSLCAELPAAAAVLNGQYPFLLFASAEHLIPLEAAVASSSLPSVSSDSSCASSPSVSVAARERRENEENPLLSLLSFDETSAFPRSGAALDVSTYDVALLRDAVTPATDGRRGRERGDSLLAWPPQFPAFLPPGRAIDTNQIFVAYGVKGGVRVMPIVGSAEGGVEETYKAPLYVPPSANANASKPSAVSVALYQGTKPQFLLVADSNNLVSIFKLAPPVSSQKAGCSGGASAFLLLQLPNPQPLAPLSPRHHPLSSSTFVAWIPPHAGGPQDGAQAGREQSYGLSLSHAGDVYFVTVQRHQVVLWSLPVLRSYCISKNINFAEQPLQVDDAVVSCCACVLPLRDALASAASLEKLSRETSRSRLGAGLAPFLNLASTPPESSLFSLPPSTSSFSFASSPFALRQPARQQSGLFASDEKHFAGAETLSVNAVSFCPASRSILVAFNERCVAAWHIEPSHNKVPRVSLIGAQFVPPTPIPPAMNEVAASILGRPLPDVPEEDCSVSLSSSATDPAPSLFTAAGEKKAFNPFDEFLVQAASSASSAEGRSVVEEKKEAKGGEQEGDSHARELLSALTCITSINVLYATVYRSEEESKRGQETLATGATAETALSAESSDAGRRVAFLLVGTANNSCLRVFPLFLSREDLSSNPFFPSARPLPLLFGSAVQTLVLDAAAPLRGVRTPRSRTAATVSAGESPEQTHAEKAESALPTKADDGFVPPPAKCASELPWAFVRVDAARHAVLWSLAGCGAPESMTVDDPETGDSPANLQKARERQSGRSRRGASTDRGVSPDGDGDAPAKQDRDAGISKDSFIFVLEVNQRMVHCGEEKQQSETENASESEAGEREAKTARLLRRASHLPLPSLLVLPSQFPVKNVSSVFSLSGAGALATQRPSLAGGPDAPSPSLSFAEFEAEAIGAGEVAIYSFFVKQADKARREAGEAGREGRYDLVQGHSHRTLQQLFRQPSIQWMPLDAFSSGDGAAAEPSEREGVRHSDVNKTEEADSAGAEEETRSATAPCGEQSSAEDGAGGAGSREEKETKADDRARPVSSPPFPAAGVSGLGAAPLSKEAASREILMRLLGKTSLPNLPASSVSSSLAPPPLSLAASAAPVAANATGRREGDPTEETHAEGNEQSRGGQDHAGMPLGTVSATSREDDSDPRLADAGEEAKETERGTEKEMEMEKEREGSKGQDGGRKGPKGSDLPGLGEGAGRKKKRTGGSHASPVLSAAQPPRETEEKGDAFEQGRGRGNAGPKSAAASKAKGEERGDRSAAVGSLQSDLGEKCASSRERIETPGSENVRDTTQPSVASEASIRELITLLKASRETSQLRCADTASSTHGSARNPEHTGKDDGEAFERAIDGSLRRCFDAVHERLLTSLAPELAAQVAASLLASGATPAASTPSPHLQKASEERGKQKASEERGKQKESEERGKQKEMLKAVLAPVVAAELGTLFSEHVVPGLKEAVRAGLADVKAVVATKLAEVRRQSAAEIAALDRNVQQVQASLQQNFQRVQKQLESQAPLQRQNSVSAQSVDSMRQNLAALEAGLKVHSEAVMKAVEGVSQTLAAMQRQQGQYQTQVAQQFQQQQRELQAQKQKVDQVVQSFRQLRQDFRADLTKTEQTLKERSETLAASAAAAAVSAALGSSPHTPGAATALASTTAVGASAGAGPGGSRSEAGGGDAGGAGEKGETGRLPRREESEEEKLKKRLVHCLQTQNFEEAFSLSIAADLQQSTGGSWLLSICSYFSPAQFFEREPLPVGQPALLGTVKILSEGLKADLRERKLAAVEQRVAWISEALFQIDGPMPQIGRSDFLDLVDEFRTNLTWAQQHVKKEGERDCFPQPIEEGLALSLKQLKRLQRTAETTRAS

SEQ ID NO: 882 - protein, 969 aa, Neospora caninum
MGGRAALRYQNAGGIRDKRKREERLELNRKKKAKKRQEEYAAARLPDMRTRGDKSAYGRSVKHPVKKNGRLSDLQSSSDEDDEEADEEVEAEEEEEEKAEEEEEEEEGDEEEEDEEEEEEGEDDEGEEEDEDEEVELSDGCLDESFGEEESDEAEDSEGDDGQGESGSRRGHARTTDPVDGNPVAHERNQGEDLAVASEGEKNKVQKNRETAAQKRQCAYVKHNALLHTQTAWGDLPLSRPLLRAIQDLEYAHPTHIQAACLRPALEGRDLLANAQTGSGKTAAFLLPTLERLLHSPGVRTRKMTPNGPAGGLRGTKALVLLPTRELAMQCVQMLQCLSKYTPVTHALACGGMTLKAHENALRQQPDIVVATPGRILDLLLNSPTVHLELLEIIVLDEADRLLELGFREEILAILRHCHRARQTLLFSATLTPSIASLASLALNRPLHISAEAAVGDSTADREKSGFTVTSLQAATAALKQVSSTLEQQFVMLQRDEHRAPALLHLCTTAYTKNVIVFFQTKQLAHQTSLLFKFMGLQYAELHGNLTQQMRVEALERFHAGEADFLLASELASRGLDIAGVEAVINFNVPADIDRYIHSVGRTARMGRSGVAVTLYHRDGPERLQVKKLLQALRGGLNQSGEKPGKSRNSKGKGDTAQDGSSAGAPRVFQRRIDADKLEALEKKVKSLQGDISRELKREKLEREVRLAELHLQKAENLQTHADEIYSRPMRQWFMTAKEKQRLKDESKALVGKDAEEREALEKARGGSAKERSGQAASEDEAEEDSEAETEDAEDNRSLSGSDEDMHGADSDEELPDWITACSDDGQSVEDEVEEPAPKKKKAKAVTVKEFKVAKPKAQPTGGHKEKKKQERLTPKQRERMKELQFMKAAGRSAKRSQMPKRLRVTHTSPEDVHSGKARRQKNQKKKHRPCWRAEESKKPQGGRDEKKERKVKSVGKKAFKSKGRYRRR

SEQ ID NO: 883 - protein, 1049 aa, Neospora caninum
MRAEMEDRGTTSGDRRPFRSRPGPGRASVPRASVDAGAPLSASVSLGSRFPTFHLSESDGGTARAAASSPPPSCARSRASPRPLAPTRFMIPFAHLLFLFALFPFPGSSLSFNSYDASPPPQPLPSPREYSTEEAKFPPPPYSTAPHSAYPLPPPVAPTYHVGDFVARAPLLAPGATPADVEAFQQFYQAEETPFDVPPADPVARPVAVPRRRTYPVQDPSATPPVPRQGTGNVRGIGVRRPYTVHPDTAVAMHEVETAHAARVAEHLYPATAELFSRLGQPFPVYTGHEDKPWWQVRGTGYDYSPDFYSTTESLTNVKEDGARMAIELIQGALRGTPAYPEQQLKVVLISKRYSGEAWDIASEALLIPTGHNPQLGHLLVAVMLNISVHVQRSCVSHLSELGPQVEARPRAEDQRTVRLVKNRDLNLPLRDFVELRLIFERVSKKETACLAELEGRLGQVIPKRMYHHLPRVSLQTLLLIPTPDDRPLDTYDAPSSDGLVTYNFVQPFRTSVLTQIDIRRDTDLALGQLSSMLVKATQPATQQCGILWTRFTPAYTALVMDSSGALYHVPLSKKTITLRQLLAVSQVIRSRINQEVTVTLNIFFPALLKSEALAVHRCRPDLWKQLVPSYIPLGGYRLTVLVNVECTGVIKVRYKYFSDGGVDCTDFLCVLLACPGPNADRQTWRLSNKMFESSEYESIGQVSTSSHRKATPPLRLWFVVAFVVASNLVFGCLFSVASWASVAPARPPPGVAFPGGFPNQHPVIRVGGGTSISKLQRPPAMAIVGPQLQAGALSHLDNVATLSSTLLRGGDGSRSATGLPAPNGQSPTSTNAPMYVLAPPLPFEQGRLDPARNHMRYYADFPFSAKDVPQFEGRLSSSPMIQAGDWLATRESNVQRHSLSDDAPAFELHPRVEVARQGAKDGPSDFRQGRENRKVVPKLVVTTVAGDSEEGPGGATENATTDDTAFAALAPRSARERARDDKRNETELTLSSDKDVGPTVHDPEGIWTSNDRTDPSSVGASLASAASASARQNDIGAWTWVRRRCAGS

SEQ ID NO: 884 - protein, 2085 aa, Neospora caninum
MPESASCASYLGPSLSSPSSPFPSACANTASGLRRLPEPCREQLEHDLFMFARGTASGFPAPNAQRKSICHTADQFKVERDRRRASDRCLTSQKFERGDRRGEIACETEAPYLTHLQPTAGDFCPTASGPLDEAAYFAPYPVTSRGKGTDGKENEAEKFGMEDLADVGCCGWEETESDAQLGGLSDAGSVSTAAPTDTPAAFPGLVDGLRRQADDLNEGLDHLIETLLVATRSQLPEQEATESESSETAGAEEVALLHYQEALEKIQDARLKDRAKSDVHIAKLQSQLQQVQAERQKFQSTLAEKDALLRRLQAHVKVLRAARASKPAREAEPSEVDELFASLLNFEEEKGSLADEDVVTNLAQASQRLAQNVAAGLQGRKKKANTPTPADVLKTEFELKLQSLRSIKGSNAPALQEWLRVFVSSWKTLQTRLKSICIPEKPTEKLLQLAKEKIEKERALTFKALVQVQQECLRVFETPWRAEELARENKEKAATISFLSRDLEKTREDNTIIAAEMKRRGQLIAHLEDGVHVLSDNLGLCQEDLTTRLQQVLENRAQLTDTQAELEQTKAALKVTKKEAAKVESHLTEVLAEFRAAQLYARDLEAQLDERTNRLHGVQDDLDRFEKANAELADDLRETRIELTKTAIELHAEHLVASQERSSEISEWKERQRRIEDNLLEVLKKPGVKASSESSRGFPVRVQTPRARPTGAFSRLRSWRRSAARGRLSQIVSAVVRTGEVERRLKAGPERWGQAATPALRDAGPLENLDATWRSIMQTVKKVERQVHSVYSSRRSHTVFARELKSLDRLLEGLQPQYRRAQRAFEALKLRVSGKAAARFRQAELRSERRGLGERRANLDDAILESKMRLAGQKGDLAPRWEDTLPVKSARVQGRRKRLGKMKGLALASGHRGSRSSGDTQQADVDSAWDDVGDFGERDATFSSPSENATLKEAASWILAVPRTTAADFPLCLPSLPPQASVSGRGRAASASGYPRLQNKRLQRLSSTESNLSAESDSRAGMDRARRRRFRSVSPGLCRRQQNRGDSSSTQEEAAQMPHKEIQRLEEELKRAQEIIKEIEETLLVPQDYFKKMREVTEENIRLNLLVCSLRADIEHCKVERQDLESLQQVRVDYAQFQAETEKRIRDLEKKLKVEAAAARRNGPSDAVVGDAAAVLRKRLENLRIDHQLEIRTLRDMNALEVERMRQNYERELASLQQAIQSVKDNAEIEYKKKCKLQQLQQETAAEKMRCELETQLREAKLEYERELQEKQKGEVELLNKAEIAQQAALAEAQRDFNKKLKEVEKHYEDRLLEHQVHVVKERDGLIARFKAKIERLTAQLDEHKEARWKTREAQDQAEVERTRHLAELERQLRVETLEKEELREALERQTSRAESLMEELGTARREGASTSGRLADRGCQAEPTVRSRGTQVDDAVMEYIRECTEISEEAMQRDGASTARTKISDVLDERTGHHRARRLLRKEAAFLSPPPAEGLRGIRKEQGVKGRKASVLDVDDDTDATAEVAVEADDSGEQRIENKFSATAPSDGGGRKLPRSYTPLSGRENEESGKEADLFSKVAAVAFRAKAGSLDPRRPRASEADWKDEAGGGASGKTPREKGVEKSTQKGTEAASSRDASFWTPPAAPALDRDTRAPEERRLGSEQDEWSRPRSSPRSSAPGISASFAGKRSQALKVLLRCRGEPAGPECSSGPASETPEDEAFGSRNRRAKGEETRGQGGRVFPDPERARVRGDASAKDGRGTSAGRDELDNGRERGFEKERASKTMLHNLSDASVRRRLEEEDERRKVRAEAEDEILRLLKRAADSSAADLNREEASGSSLSELGTRLFRREDVRVFPASLDAELERLKERLRPGNSVLKAVRDRGASSQCSGGDNGSAMPRQRSRRPENLPSSAVAGADMGEAFRGSKSSCLAGPEKWRRQDREREAPQQWKGERSYEASPADGRPHPGGEERAPGTAFYEGVKSETAGRREKTVASSLSRTSSLLEALSATSHQIHIERSAVKYGLNHLLQRQEQSRWLPGFARSSRDSSGTQASSVSDQMKALESLETLSRHVRSGRFDAKQ

SEQ ID NO: 885 - protein, 1641 aa, Neospora caninum
MSSSEDEDFQSSSPSRSPPRSTPENGKKSGGGKPKTIEQRYQKKSQLEHILLRPDTYIGSTEMHTQSLWVMEEGQECMVYKTINYVPGLYKIVDEILVNAADVKAREGEEKKGKPLKPGARRMSAIKIDINKSAGRITIWNDGEGIPVAIHQEHKVYVPEMIFGQLLTSDNYDDSECRVTGGRNGYGAKLTNIFSSEFTVECADGERKKKFKMTWTRNMGQKTEPEISSYNGTDYVKISFVPDFAKFGMRGFDDDSLSLLRKRAYDLAGTAGVRVFLNGTRIDVSSFSQYVDLYLGGRKSEKPRKEKDEDDAGDDSDDDWDEGPKRKKGAKKRKKDGQDDEETENGVETKVIKIHEKQWRWEIVISSTDGGQFQQVSFVNSICTTKGGSHVTHVLEPLLAAIVKKANTKNKGGMEIKAAHVKQHLWIFVSCLIVNPAFDSQTKETLTTKPAKFGSKCTLADKTIGAVVKSSIVENVVLWAQTKQQVELRKQMKVGKTKGRERLSGIPKLEDANDAGGRHSQECTLILTEGDSAKTSCLAGLSVVGRDRYGVFPLRGKLLNVRDASFKQLTENKEIQNILKIVGLQVNDRTEDARGLRYGSVMIMTDQDHDGSHIKGLLINMMHHYWPQLLKCRGFLKAFLTPIVKVSKNNVEKAFYTIPEYEQWKRSCNTTGWRIKYYKGLGTSTDREFKEYFNDLSKHQIDFVWSGQHDGELIDMAFNKRRAEDRKRWLQSYQEGTFVDHNASSLSYADFVNKELILFSRYDTERSIPQLVDGWKPGQRKVLFACIKKNMKHEIKVAQLAGYVAEVSAYHHGEASLQQTIVTMAQRFVGSNNLNFLEPVGQFGSRKEGGKDASAARYIFTRLAFYTRLVFHEADDPILEYEYEEGQRIEPKMYVPVIPTVLINGSEGIGTGWSSFVPNYNPRDVIENLRRYIDGEEMQRMTPWYRGFRGKIEENSAGTGFETSGLVEKCGEGAFEITELPIKKWTQDYKEWLEENLPTAEKRDTLIADYRDCSSHEEIHFTVKVSEERLERPEREGLEKYFKLKTSLSTTNLTLFDPHGRVQRYANELEIIKEFAPIRLDFYHRRKAYCLAMLEKSRRILSNRLRFILAVVNGQLIINNKRKKVLVEELFSQGYDPMKEIEDAANAGIRAALKRDIAVDDEALAEGGEEEEEIVAGCTAKHYDYLLGMPMWSLTLEKVEDLRGEMREKELELEELKRTSVQTLWKRDLDALVAALDKQDEIDEMLLQEGRRFQKKARAGQALLQAKKKLKAAPQKGKPAAKKKHSTSSEESISSESSEEESDIDESDEESYTPAKKPKSKGTLPSARPASAGALSCTNTPASSDRRRAVPTASTPVQNKNSQDEKETKKKEDAAAAANGTNVSAPLESAEGDNGASVADRSKTSLPSPTITKPLSLLERLKMGSSTSSILNASSSQKKQMTLEEIFGSRIANKPTTEKKKDTETDEKNGGEAAAPDSPAEGSARVAARSETSLFLLSDEETTKRPVSSSSSLGGNERSRVASQGSQGIQKRRKSKVLVLSSEDESDEEVETKSKKRKAEASLESTPKTKANKARRQSTPKKKASSDEDEESPDRDSVEPSPRSSRPQRRAAASPKKYKISDSEEDDESAESSFASDGDEE

SEQ ID NO: 886 - protein, 11957 aa, Neospora caninum
MAAWRVVVHDGSQQVSINSQGPLHTNGVLLLSDLSGTSVPSPDGPPLPSPSSRQSCPVHTIDVSSPEAVGAAPARAPRPVLPAPLSILAVCDEAVAAEGDGYPRVSPSAGTYRHHAGLLPAADGCLGPPDVGRDAASWASGPGLGAIPPVSSAPAWARPNSQSVPFPSQPFGRGEQANLREREARGGSGSAGQMADSPRDSVALAASEAAIAAGEAFTPYTVLGRVRLLSSSLDDRTEFLLLQGVSRLLRTFATAREELAAREDRRRRRRQRAARSVRRPRDGRHLEEVRGGELFRAKDVVASPTCASKVRRLSRGTSDLSSLQNRGEQPAAREPLVESKSDLCLPEDPRKMQRTGPVLCCQLRLRCLSPLVSPRYIPSPFVFLDADLAFRLTCMLSAVCRASAFKRVSFSFPPLAARDLPLLSLLNGRRGLRCGKGDAEPATGDRGEHNPACGGEELAHGRTDRRRSSLSAEGEEEDYTFSGEPSLVLPGLHHFVERTSTADLYRRLLWLHVTSGGFSVLSVGSSGSGSESRVERNRDQSVSAFSVPSVVDVSVLLQPALAVAGPFSGLTASSRTGAVSPSSRSRGRTGDETDHFFDLLEDIDNIAAATLGHSTSPGRQRGKSRELAGQETAQKIKRRRSSSRIYGEDADEDSGDEDDEGDDVFWLETDDGRMVLPRQLHPLCAFLSVCLQDASCIKREALDAVHEALRPGGRWPPASPTAAGLPKQIPSPNGAQGGRYGNYGSLRGPGRFEGETAEGPHGGEEDEGVAWSLREGGRGTAFVSLPPPEYPRCWAGGNGATDDALFAAGGVSGLSGWPRGGGGAESLSGAGTCTVGSAGGTLLETVEARLLQPLVGLLTESLVEGVSPSDRDLGFLRGPCRGFLFSEARHWGSPTRGGDRGGELAPPFGPQPFSPLSLSSSSAFRVGSPGRLPGFSQGYPTGLEGLQASHGALGLASPRAPEPPHALALAALARLQPCFLGAMQEAESSPSSLLQTQGPYEARADSGLLSSFRGETGRALRDEEEIDVISRCLDALLLLSLHGASVVSLLDFLKFLQQLVAAVDRAEDELAASAKRARAVSPAGARRNSEFRSTSGRVASSGCTVERPPNERGGCGKHSDADAYTSPVSGSPAARGTGGVGAWTQRHGPLALSTAMVTHQGERRAAQWRGDPFSPAHRECPRLGRSHSGASLPSVPVSENPQDRSSGVDAQSQPPPEPADLAACFLPQPATISRPSLAASSPSASHASSPSHRASAVVRPAFWGATREGCQAVGSPSLGECVLPRSPYPSLQLLELLSLQFPLTFSDLSCSSGGEGASGREESSGNEEGRRADELPRASGSDVQTSLSPSLLLSSPIPPFGAYCFQMTLELHESLQWGFSLPSPSSRRPGEHCPGSPLHGRRAPLVTPGGSRYYGSAEDFDGLRGGGVTGRSAPRSLGTDLSCCVEIIYGNERNLRLSRRPVNEDGRDRSGMSSSGDVDGGEVRLRLELNNDALVVWVHQDEKTGARYPRGVTGSNERGSAIAPGDFVPSDSPMVSDCGSVYPESRGAASSLRTSSDSDGDLVEKIQERGEKSVRAALFDIRGIHAIVLDILVDQTGEGEDEGVAQEWLLPDLGACDAEWPARAETKRSPRETDASGVSDEQVPETGGRETGVRRSRRRGYSPHCRSGLDGRASAMFGPQRSSQVPLFGCRETTRGDASKKKRHHIVVFANGQKLCSVPLPGPSVLLSSTLSVNPANEVMVRAELTSRASLRVASQPSWSLGFIEELRRRRLIGGEPAEAEEEPSDAVIEWKRRARSPRGDSLARKGARYGGEAFDEGAMLGEEEELSGDDDSSTASFVSGGGDERENGLEMSESWERPDRKSEGEEARPAERGRLRDEVFDPEDPTPNFPAQAASGSASRGVFGFALASSDAPSFGSKVKKAGLLSLEELLQRCFFCLHNLILRTRPPTGVSREAPRPAGWATISEDERQDSAVGGAPVSDRETGDGVVGHAFGILSAPGKAILFFESFLDSLELQCLALKRARDEAIRATLEEETAHLVARFSETQGCGGEDAEGRPGRSHWGEPEAAKVSSDASSNLSSASPIRSPSVASPSFRISADASNRSRSSVPRSLPSPSSAFSVSSPAGETLLAPSLTSLSGLRLPPVGEEPERLERQVGPERRLHRSEGETATLGLPLPACSGQKHTRLRTKWRSRAEVCCSLLGSLRAFLEDSKVIAELQDQLTRQPQALDRLSCLFFDCLMFLLEHDAPPVCACSAPCVFEEGRGSPLGVLSQGETGFHPHGSGTSPATAVADRGGKHAGIYRTSSSASPSSFSQQLRSFLPTDCGHVPLRFAAIGGSACSSPLSRSRPQDFAPATPSAVGPSSSDAFSARIRRSSHGSITSLASSQSSVDASSSKSAPLVAPEGPARPSLCPRTCAVCFCLGAQEEMDAEGAVWLLHRAALKLFSAVQAPLLTSLLWRVPPEKLQVFLRLLAANTRPFEVSLVRQALSVLDSAGGCEVIVHRLLREIRADDGRKQDQTLCVKHAAGGRRDSPDDLRRDCPPSFDPFSSPGLASSLPCTPTHRRRGDANFPFGGGQFLPEGRDNLPRGRFVRGDFSPRACSAFAPTPGRSSPLAPSTLPSCVASLHRSSSGGPALAALGTETELVSSSRPLRRVPLSRSTSVSCASSAHFRKRERRENLFPHLRSSLRSASGSQETAASRIDALRFSLSCLEDSGFWPFFRSLVSQTERQIEEALRLPSFARVSAPAGTWGPAGRGGSRPGARRGTQSLSSDRVAPGIAKAFSPFYSVTYPRDATSDFLAYTGAPTNSAAYPASSSRFVLCPHLVGSPSCGIAMSAAAAAKGDNSGCQRALFPFPSRSAASPLAALCGTAFYYRLQLLHRGLFDSVSARTNQSSLSSLDGLFAGRGSMFPFSSRRRALGDDRDSGSCARCEDSQDAENGGAPGLAGEVAGLLARHAAQKWIKQLLVYQAMPDTALPHRRQGQVCDPDVFAQDDTSYTGQRPLASAAQPASSKGLSTSPVDRAAHSGLEDSENPRESSAQRPPPMSSSWLSGCRRYAGGWSEEDHHLRRLEDVCSCLEELLRRLLASGQSVLAAMMEAIVLSDGLQRFVPVNGCGLRECPRRTPGKNAHLISPWKGGRSPETTTRRGTDPEMPLQSPRGGEPKGNEDANRIASRRGEAPELEQGRDTVTCTAQERGAETVSGEREETMMRLADSREWTGNEKAALVIESRKSIQEDSSGPVGFSVGVLTPVEVPMRGTEFGPASTGLPPPFLHGCAFLKTAVLRVLTQFTSMLSCFDSAEGGRGDGTENAEDVFKNLAAEKDGACASGKNSVVVLALVQMTLRLWPLVLRLALRALLLLRQLSTCASESGDEGRDCSEGEGNPRSFLHPFLRDAAPEKKLHPIVEVCLGFVAVASHILVTLGSIPSALAAFETLAPGQTRPEFPASPASRSPVGADSSSFFSGSPSSHAGFSSPLASPVAAKGLLAGARDKSAEAYLEVTASAAGLPPLLLTGASYRVAPAGHGFQAVEGALRASVLMVLECTAKTCGPLRTNHFSLPRAVQEFLSATQPPKAAGAADARGTKMPSQAENNDPAAQTVREKEGRDTGNKGPDRRAGTAIGGARDGDEDGNDGQERFSGEETDAAQTTSASPSCGGNKRGNCVDEVSGLRPFTSTGRLTGSSPPQTAGRAPSSFADRHQSPPALSASSSVQASASPHVFAPSPSASSPSPVLLGLFRGEQDIVAAFGPSMRAFHPSLASIQHGVAAALLHLLGYRGDPRTPQSDPCSGTQFRGPTEAREDTSQERPLQEGENGWARDGPGAQGRLSGELSERPVTESTARLEREGGASGRRQNGELVMNPESGSEVAERSQAASSAIVHRSGIHSGAASRERPGAGFTENPSSMSPLDIRYASYREKEKEETLRILQIAASESRKAAVQLLARWQRRKAQRAAASTPPLGEETCARGPAGGEETRWPASGDEPWRIASASPVNGAFPGASSGGEQRREREGLHTFAVSEETLRAQERRQIRLRCEWILQVCPAGLLAPPGGAVYAMSPVRLRRGGWTESTVSTHARYGGGVVAGLLEDEAAFLASFSPAPNLLPSVALFPPRHQTRSLSCVDSVSTGPLYRVGAGPDGHSTLAAAGADLAGAAGGEMAGGLADASSSVGASAEDVLFPSDVSSLPGIHDYLHLPRLAGTGFPAAGLSLSPSPSGPMTTASLSGHASLTHAPLEPARGLSAYRGSVPGLLCLPGRGTGVSSRPFASMGHLGPLMTFVPGPFRPSFGRLTSAEGALRHSVTPNLEVLRRLMSSRTLAAIDRRSSFFSWGERGPGGRLLTGRLFTHAGTDTTEGAASDGFRLLSSGTTALDFFGGQPTTPNSPRFYSIPPHMHATTFYLPRRHSGGGGLGFLGAPPALTHQFPPGATGLRTAASSFSLVADEGRENGVRQRQRTASEAMSEALRQSVARNGGNGPAGDREEGRSAADVPHEGLCPQMRDADLAGATGGKASGVSPHDRSDGGLDTGSSVCTQTPSHPFVSHGTPAPHSPFYPSPTGSPPCFSHLSPVALKEAEQEKEEALAAFLGFLIDGPDVFVAERVLRIEQLSSLCRYVMVRSLKALLLAGICGNVPNIRSRVAAARQVYPALPCEDGKNCGAGSRSETLTARKKGDGSPGFASPVSFSCVAFFQPSFPLASRNRRSTRWPLLLDLLVPVASRSTSERQTPATAPSGAAVRYAGWMLLKLLHRVGCMLLASEPAATASASLSGLLEADGGKSALPSTLPGESGRPSGGEGRPHELPPKNASGENAGGADRGRSFWKVQPLAEALAASLADVIRVVADWHLFHSPPLLANLVAPRLPGVFVCQPSDTLWLDSCLRVLALHVCLRTPPMDSSAYVVPFLRHLLCLAYPPLLRRRDAARPASTAASRAGRDGHGGRPEAERLHDSESDSDATERRGRLPGEKEDHDDACAPRSAAENSSGAGTAASRVRAPVPLAAAVTGVVVHWTSGLARQQRISHAATTLKRDGFDLHWKHSARGGHTFSLFVQRKRSAPSFTLPVLDLRAVKPLMVHPADSSRVSASCLPVCAPSFPEVPVSSAPGVLNEEAGTEAGFRPGREGQPSRQLCRVPEGAGLWLLSGRPASEPDGLEEAISDVRLVVEHEAPAAATTSGALCLALTKGARLPASLHPSSSAAPPLSPEVLRSQGYTVETAFQVAPGLVCHVWVLRGPFVYHVPPSVSAFSTNQMAGTESTRAAGMSSLPSFPALSRGDVLETRPSKNLLSLLRSEKHDLTVEGDLQKSIRRRVTISSEGEGGDGPGEDLLPSALAVLDSSRPRPSPVDLLAPREETDEEGREDSRRSSMFGGRCSCSSSDHGGGRSDSSDLFAPQTSAGFLGVQGDSSGGGEAPLSLGLTAAPLAAVEAGRRAEGDDAPELGEAKRRPDAAPLAHKLGASQRKQPCCSAMREYRGAAKLLQRRGWQLFKSTVWALLSGLGPLATEQEGDSEEMWGDFYFCRDPERRLGGGLEKGEDAPWSVSHLSGKDVSLEEMISAADARAAEGRSGSKGDLLSSPGVAVGGSVRPQSTRSGEREKVLSKREEEQRQRRAVAAEALKMMVAAMMRLTSTLEKGKQLREEAGRKLQATKTASAKLCLLQRHQVHLHLGHSVTGRRASSPGSSRLSSRSFSRGNSYVSALGALPPSYLSHRPRSLAHWFRDRGEVPPRGMSPSRARSAVGPLATAFASSEGAAVAASAPPSHLSSFSRVSSQGDRRSISSGLAGGIEEGLAPGSAPEPREERKERQVRRGADARDDDSGGGDEEGPAYARLLAEKIAVALEEAETAAREADLAVARARAEEKEVDAAELFLEQMLELLLACAQQNRAAAVLTVGVLTSIREALLAKLEPLLQQDKVRSTLYRLLVVCVRAVPPNVTAFCEEDFGGWRPRATLPQDASRLGASPGRGRENKEETGAAQPSVSCEPAKGSEQGDGGHGPRGTEDPAGHIGGAREAVPKPPGERDRGQDLEKKPLSRWLPALQPLHPAGALASCGPLVVLESPAEEDESEKASIRESDACPQPSVVFTHSAVPVASSAVITQELPSENSSPTLLPVLPSSDPIPPLLGLSGASHPAGAPVPTQPSSQSSDRQTSLSSSSAESTGSCGVLPLSHSTEGVSTEATGEAGAAGGARSERGQVEDLQHPPGGVSGFEWTEGERGETGTGQNAAVEPFPPRADPLLLLLRDPPRPANHPGTPQAGSGTGPSGLSSSPGFASVPVLAPGSSSSASLPAQSPADPSAVLESSLSSPVDRLHPLSRRIGSDGWDDLESSSMPFPFLRAQPVPASLPVAFVSAPASHAPVSVAPPAIALSRGPTGSPAGSSGASPAAPAPLQFLTPPLPAVPNGGLAHPPPQPAPASGVGYAAGAHVEPAAAPSAASAFEGLPQSEIFVCSRTGPDFEAEVIESRTLHVLRARDLGGVVLCRAPLTFPALQVDDEDSTPPDILNFRVLTSGRFGVTVAPADCVLSNAQEVFERNDVVGFRTESCPPYAHNVFATHVPYQEGDYLSVKFNVDLQPNGQRCLHTELHVSGESIGSVLEVFFDVESQAEQHRRMNLVFVLQDPLTIVYEGPPFTLDFVDPTAGFAAVGTALPTLPAGAAGEGAGPSGADAAETGGPGPEEEETEEEPGMKEWRCHKPLFMDSLRLYQAILLSESHAMRRLRGEILTTFLDAFSAATRAVETLQTALEAEKKCHRKPGAGRLRTRRGGFQEAATASPIVAPQMRMGTDGELAEILPHTRDADGETGPAPGRRDRSSRPGDMTWVSERPAASSARRPPDGEEEEAGASAARREHLAVRHQSAADTSPAGAPGSEGQPSSFHMRAASFSRTQGSSVSPLLAEFGPSGTPDTVSRLRRFSTCSALSIGRGSVGFPPFPPSFDARDAGPGETPLPAEAVADCCRALSALAVLGCAVEETDQGDLAALLGESTEDGEPSGANRAGNSRPSAGSGGRSCEGGPKRDSGLSPAAKRRQREAWLPWLVGLSNLRGAVVFGLRPSECLLLLAQLVRLLTAPPIETALRELALNGQLTARSKEEQTALSLTLALGSKAVLVECLLVRALLAMFPEGRRLGVGHSQLRELLQSRDSAASTGGWMKEVGRDCLTDMQSWEEVFEGLLDVVQNFCLVSAGLYSPILERPTEGEVVALMRSSRRTAGLASWGGRGGESEEGGLERGEKEPFTPPCGPFFPPSPLTSFASSSSGFAEFFAGNSHFFSFSSEDFSSSSSTDICASSPVALPSLGGPSPSLSFPISTETEGGSDALRQLRIAQETAAPPAEGTAGAAPKLLRLGEIARLAGVPEEVLRMDSLGSPMTIAQPVIAIEEVSVVWRWLFRVNEAWHALVESAELERSAEPREEKRGRRGHEQTGTREDDSGPWSAEKSPSKRPQTHRSPQRADELMNAEGWSTQIDGVEVKTREAGEREDETEEGKAHKETGGRERLHPSVSERAFSFSRRGRRKHEELLVSSSPFPAHPLFFLMPEQQEGQMFTEEAPDVRVFNLEGSAPFWSRRTAARLDESPARWAIRKDFLYLLCSLAGFLPDLFSNRLLRGIKPRAHTSQVPSYCPRTVDDVGTSAALPEALNILRLFRICIYFLSREKEDNAPDYWHKYRYQLTLPDASAKTDENQKSFFKEIDEYSVLADPLFGWQRVFYRAIVSWKERRAVMRLHRLLQTEQLFHLIGSVGQVLGNKGRTKKSPKYCALAPSVFVAHWLLDTFVRHPLCPGPLRRGLVSPLAWSGLFALLCNGSNLPMKLGLDAARLTFWMVARHTGKDGARFRDEGERRVGRRGRRGREDPEGLERGTKTRGSRRSGRKEDEKREFVNSLDRRGSEIRCEESEETGREIGRETWRSVGDSHVHRRTGRGGRREWNWEEVSYRQRLLQELLQRYQDCLTYCGASLVEHLEKPNSWKAASVDCFTGADMSRQHVRYRTNAGFLAHYLACACVVIRGVPSLGANLSWLPLKHAAPFIDLVDYLAVSGRVGAAACLPTQGAQEGQGARAEDAHEEPASGASRVEEVDVEEPVEKREGRLTVDAEERAPSAGEGAEERREEWVRAKDAEVDGDRDSGWHQADARLDTIRGPHRKRRKSGRNVELSIFPASVLQATHALPQACALREHVLVLPGVGRIAGARRTTLTLSMEVDGDDNESGSEGESYFARSRRTATSGVAPAAWEDDIEPFGSRKTPKLLVAADPLFRYILAELDAGTTHSASSSHARVWDVTVSRGLTDETSLDGARVASLEPGMESGSFLQGWAKTQRSGGLTEVSESDVDGSSAASEGDTERIERAAFGFAFRPSRLGSQPRSGKTSSTPSHLILRNLHAPARGISYAVSSLPLICGTSRGHCELSFSLDCPESPSSFRLLPENAREPCGDGAGRADALGASGGCAFSDWLTLEDPTVFAATAWPLSRVFVGVVAVRSRSDLESLQRGDWDGTSHAALLQLASKTVCSGFASAHATSLAKATREARTRERDGLQSPRRAHRDGNRFHLPNRQWTLQGTMAPTAGSLLRELLPRQRGTGRHETGNAMVSSRPQRKRGNERGRAPCGRVRVSLLTAGRHVTWVVDGAVAACQTLPPWCSRLLPVLVVAASSKRNGAEGLPTSAAAAFWSQVGLAVAFEAPETATAVCPASTSVASAPRSLSSLLSRGFSANVLSLPLNELFYRFEPAPVSRLARWACSSASETSSSQADNRGVWGAAGDKGGRQRHADSLLGEATHCLMLVDGTMPSADSPLAAALQGVKVHTCGDVVYLSTRASPLALLRSRAAQGAGGVSSVASGTFLTQANRLSKASHGSCPSTSACALPSRDPKAASACRGAALADATGAADGGPALLSSERTRLFGEHHAETVSVPAFPDVSTASGSPSAAGASPAKKDKTTLASRTTTGQEEPSSVEANLPLWALVSPDLRVRSGVSVSPPKGGPVSFGSYGVWRWVEAGQAQLLLPAQSAGITSSAWPHSGTSGTLDEREGVLASRALCLFGEGTGDAEVETERLPTSSLGGPQPMGAVLGPQASLRESVGRPESPESDGVVPPTDRLPSALFHFSASRRGAAGTSRALVPGVVVPSGRRIVGAPWLGEAVHPALPFSFGCRLASSLEKLARGSRGEVGEHPAQLPSEHSPHPETTPSGPLAVGVVWGCCRWLWVSDGRLICPWDVPTVPELRLFYKRREKALGRRSGSEQEAADPSAPSLATTGLQKGGGREGTAPLPAWREAQVPCPGFEDGDHVAVEFVPAIPALLFFRNGSYQFGFHFDSFYRLAERRRVRHSLDYFFAVSGPKFARGDSPRKNRKRTSSPRAGNRTNPGSGRRDAAPSGLGTARETGGTAGAGGAHHGSSLVASVGLQDSALESPASPVSCTPKDKACVLYKSPLDQYEKEGTGVTLLYRGLKEGLPQLVAHFIALHPGLLEEADLLASPCSASMSAIEASFLGTLPPGSRLPPLLSSSFSGASKRHRDPFPSPTPPSFPGPEEALDESPLWLAVVSKNEECVRLLVEEGGCSPDGTTPVSALRASMLGTPGAAAGPLPADGETPLMAAAETGQAVLVSRFVCVYGANVNRRDARGNTPLHRVCLQALALDDQLSPTPQRDAARGSGGNAANPAQAATPPAARAEANAASSLSGTLGFPDAPGGVPAGGRQALAQPIPRLSASDADGDDSGAGRGPGALGGRGGSGGSPLSAGGSQDYRQSEGGMSTAASPSAESRREKKKQGTLCASTEDWYNCVDMARLLLHLGADPEGKNDDGLRPLDLLQATRGSSDGEKAAARRQGRADGKEEAAQGLRARGAEDVWGSAFDSEEAEASGNASDQLRRFLATWTALYHGGGGSGRRAELKRPMPVPAGAAGPTSGAAEGRSYVGSRVSSCLEITQDFAFDSQEAFTSPCAPASGRWFGLLANCLPVVALPLPAASPVEPRDGAGDAEADLTSSRRASLSLSFSSRSRCSSHSGHDTGRSREESGELFSSEEESCRLSSAWPSESAVLGPAAILEKLEIDGEVWGGHAKAREGSSAADIVGHLLDVARSPSAEALNLTPAAETRGRDEEGGRDAHAAGQAEEQVHAKGDEEGDPRSFVSRSSAPILSFQSAGADPSLSSRGLSYSPPEGLVSCGVVRGLLREVAGFLLQEFQEWKRSETDPTVSGGSSSSCGHSTPGLGHQNRSGSRGTAPARGEGVDQQALSSPTYASLPHGSVAQGASGCTPGGDPSQAGEESHQGFEERLDQAIQATDAIIEMIGSAADCEALRSCAQRIVNLLRVLVGDPHFLRESPFRLSPAPTASVQLPAEGGGGGGLPATSLPRSRLQEPLTSNLRSLEVSLDASRTLQDLAWVVLGLENIVDVLGEAGSASASSESLPPVPVSHPLPGSFRHQPDVRVPRPPYSRSRRVSWRRRLASQLSVTRSSGGPGGLSWTPCVGGAEISSLLGVNCLEGVGSENTSSRSPSPGASHNALWGSLCAGAVSASSRRHNEHGRGTSRVPDPLGSLESGGTGVWQDCPRQALKRPQSCGGPWRSWSASSAVASLQRSQLREETHGTGDAPQTVILDVHVRVGAEDSVLRQLMMAWPLSLDVSLRETLDLLAPDLAAGRSAGEDQGGCEEAEAFAGIPKTEPEMLDFFKRVADGLWTIEEDREELLQRLEKGLPKKKILWKIQALGPEEALERATSLRRAVWKMMETAVHRSPALPHSPAFLYRLFTHLLVLRLRLLVRLNAAALRAVPLVASVFNSPSLEQDFHGLLTGDPFVFLHGAARRLLPWPRDADSGDSGRRNGRREGTFDAVSGGGDKTRDGKRRPGRGCGRRMHSRRSEEGGRAFSPTARAAASFYAHTKMVVQAGPGDLPVQLSVYLFMRPVLTSETISALWGRALERVGVPSHDIPALRLDRGLAATAKHILHSMLYQATVQLLASHVNPNKLRGRPGDRPFMVVFKGEGATDFGGPFQEFLSCVGREIMGSLADAPDGNLPNFSPCLPCPNAAHAIGPHQDTVLLRPDDLPNSPEPQLYFRGEIEALQGETRSVNAGEEEGVGDGAREDVDSDEVPPGRERRSGFRREDQVSEERHTDEAPREPANGDTEDEGSSSDCPSVSSGGSLSEGSSDDGDEETGLPDPEGVSRDAARVEPQDSAASATLATLDLRRDDTGESAHPASLDACPLTEALSPLLAVVASRSEGEHPAAASAVRLLSGDALMRGGATASSSFFRSFFSLDNISLQTSQRRRRGACRPLSCFDPLEISPVGAPCRDRRTRRDSGPNGRLPAVSFLPDSQTLQSPQRALASSPSHSLAGQPTHPNLAPLTPVGTAPLASNPPRASSHRSQGNGGRGTERPHAPPASEPRSAGAPSASGSFDFRQETGGGIGHFRLRREDRPMFQLPSPLPALGHPLARTASQVGDSVDSANALSPLSGRRLHGSSPQASSRPQAGQAIAAEGGLAPAVSGPGGVQTLADALPERRRAEHEAVPYIFVPSEPELDERRRGRFSGPAPAATNPAAGGPRPGPLQNPAAGRGRDPTIGHGRSLTPPPLVSSGNNASSSLPAYSFERHGGGRPSGAAGAGPHGMQRGDGRNGDSGRDRAFDRTRDENRRPTSPAPAQRGGVSREGGMFFLPSQEDGRSRGFPGNDGGPGNDPGSGGGGGPGPSGGRRDGEDRQGQGCLDKDTERRAELAMYEALGRLLAMCSCIGAAFNASLNPLIWKKLVGQPLQIQDLADSDCVAVEMLRSLRRLAAVPPSLWDEAMKSSISDLTFMTEGSSGQPFELVQGGSEIVVTPKNLELFIRLSERCRLLEGQGSLEALLRGIGAVLPLGRMRMLFDWRRLEYRVCGDREVDLDLLRSHTTCGSEELKATLFEVLETFTNDQLQRFLRFVSGRSRLPSSGSDWRMAVDYEIPEGQRVPPIDDNRLPTAATCGFRLLLPRYTSKVIFRQRLLYAINNCTAIDLDAYVVHEQMTLMYED

SEQ ID NO: 887 - protein, 822 aa, Neospora caninum
MPAERKRRAFLPSAALVSLLAIRFSEEIARTALSSAFAQDAGSAHKPWIGNCPRFGFSFHASSHSSSSLLETPFVVDSVAACAARCHGFVLSSFFSSTLCRGFEFDRRSRLCSLFASLPSPFASLSRPSPFIASGVSPTKTAGSLCATSCLVSEWSAWGACEGEGRTEPGAYESTSGIQRRTRHIRRLPLWGNETCPLLEELRPCTRGDSPQCAMEGIGILGWGCNPEDDFAESGTDRHFVTSFEACGNLCASDPDCTFFSLDRRPRASASFSPGASPRSEERQDPFPSGERETHDGQEVSMLCYIIHGPEPGCMFLSEHFVSAPRQGGASRCPFDCVPGEWSDWAPCSHPCSPEQQQSRTRGVKIPARNGGRDCQLVDTRNCLGSPMYPRVNCAQAECTYSPWSSWSPCSSPCEGGTQERVRSVLTGGSRPCNAVKMVRACNDGIACSSRGQDCEFSAWEEWSACKAVPGAGCGQRSGRRQRHRGILKQKKDPFSGRPLPCGDNQAFVQVEDCVAPGTDACADACVMTPWTNWSACSATCGEGWRTRVRSILRPLLSGSGKEGCPPTVETEPCSKTELAPCPPEEQSEENGLFSWKTPQCEMGEWQPWTACNDNCQRFRFRLPLSAAGRPACSVEIQEEPCDASTCVAAARAASSWSGAGRQAAASQAGSDFLPSENFSGARDSFSPFGSAPVVLPASQADVSAITRACLLSILLTLLIIFLFIYFRKKGIRGRRYIYPLDGGWTAASSFAGDNDETTSFVMTQGQENSAEGSQAATAGAERSQEGEDEVESNASEKLAKVDVDQDMSFWDDDDEETKEDK

SEQ ID NO: 888 - protein, 4189 aa, Neospora caninum
MSPPGYAPPKAPPWASQASASLVAPRVSSAFERAEGDPAARPRPDRSPDEGDQSSSGSGDEEVSSGSALFLLSAIQKEINRHPLIDCGNSTPPLTPRSPGALHEETHSSSSSFSTSPLVFSFSSSPCSVAPPYAGLASSLPLTSALSPPRSALSASLPTALLPAQAHQLEAVPEETGERPESADFLSVPTEQAADQGQGRRGSSPPLPSFHALAPSPDAERLFPERARGPGALPAQRVCEEEACEEVGEKGVRFRARNERETRHTDSREETERPFAFVAGSSLHHSDLVASAGPDVESRGGREGGRNAQSETVKEDGEKTLLRLQIARLRVSLQTTEADLQRERAQRADLQRELDRSMALLAAREVPAQLEADGVHSSLSSALLLQRLEDKQKDAFLKAKIAEAAELAAVLQAQKVHTRAETAALQEELDFAYRKVEEVESVAAAFERRVAQLEKELASLRTASTSLENRLAEEIASAAAREASLATALSLQERQVTTLEREKVEQAKRLRHEEEKSALLARTQGSVRELQAELDEARRSLASVGCLSSFSLRVCGAEREPGDEGQGRQDDGLLAYDGQDFLLRLEREEWTQVRQSLESELRTLDAGLAEEKVARRQTIEALEAAERQLLAMEETLGRGQEAEERREAEREAERRQVERFEAHAAAQFHAECDRLCASFREKEAAWEADRAQFAAALSEKDAALLAAHSRLAESHLMLETRESRCQQEREVLAGRVREKEEEIYSLRDALRRQDEAARDRGEAWERERERDRENFGVRMQEREEEVHALREELSRRAEREREREAEHARERESLEESLRQQAADVRGLREELERRERSLAEDRAWETEGRAREKRGAAEVREENGVLRAQLREQEEEICALKETLGARESEVAVVIQNLEAKHETLQTQYAAISYLNRELSHRVEELLPLLAEREREGGREMRNAQAEPRGEGNGPETGDSEAGARGRPRDSVEEVGGDGDPTKNDAELEESSGPNASERKREGKGGFSGPWPSLLSSSFSSTSLAVSRDISPDLLAVSASAPPSSAPGIPDQPRGDTRLRASFSRSEKPSSSSRLDVCRQRARALLDASSLTSSWDSERREGERAFALDSGRGFALSRSDDEFALSTSCVSDKQKALDLFTHLEREIWRSRKVGPPSSSSSFPASSHRQVTPQPWFSLSGTRDAGALPRAERGEGGPNAHDLGSSRAILGWALAELRALLEQRGDIESKVEGREEEEGNEVEEEAPTEGETVEISRGTKQGGARGEGEETGLCPAGETQRVLSGARLRAELGSVRAQLERAETAKEEKEREVRLLLSQLRRAAAAFSNSRAAPEDPALPPPLPTTDGFCQTKKVVKDSFLSRPVREAALEPPQVVAKMEQGSQTEENEEGEKEKAKGEDTSRVERGDRPPLKSAEKGRTEGVSARSVSLQTEGVVSARSVGLQTDDNWLSGFSVVLAPHSSLPARPPPLAVAACGAQANLCDLQAAWEAGELLARGARGEPWGGVSQAVVRKHAEMQTETPDEAPCLHCAASPSASPSLARTLVRHVKIQCSLRGREERPGKREAESEEAREGEREKRRDGRARRGKETQAAESEDATTEPGDSDWGERDDERRHTGDSDSGDRDSDSGDSVGSGVCRSLSSPSRLEGREASLFSREASEGTRLGGEADRKHGEWSREGDRVGASRAARRERRHLQAGVASERVKPGKEEGPSRRSVHRARETLGRDTRKTLQWGEGAWRGDSHGRPRDRRERGSESKRETGKDPRTGGRKREREGDRGRGTRIASSDTDDLLPSDRREGYRWKEGGHAVKARRSSRSLARSSRRSSSRRRADSSRQERRGTDGDGRRRGHSWSESSFSGECPRSRYFSERRPREASRRRHERRPASSSSPCRHARNPRSSRLRSQTHSNSSRSTFPPSSSFSSSSSFSSSSCSPRPRVGARESVEALVELLKEVDGVRGPGDSVSRRPPRARKLRPAPASRNEHRSRGARRRGRGEEKRSRVEAALSLRLAASGDSSRSADSRERRGTRQRRWTEAGEDARLSLLVGRAQNGLDAFRGKRRDTRIAERRRDSGARREKALFWIAEGSEIDVGSGQRRRTGNKLWKREAAGEVGPRAERAVYLHRNLARVAPDSCFSETEARLPRRARVSATPQVLFRAEVLSTASPFSAAGARSPRSLLCSSCGGGAFVLGGNDRELAAELAADTQATSSSSRSFDPSSGPSSCFLSSRSFGDERVSACSVAGERPHGPRRCRSENPARCSRFFCARAGEGATGGRSSLVLTARPHQASGVQPRDWGGAQKIVFFSPCSVCSTAASSPLMPGAGAIQKTSQNDRGSSSVSSSSCSSSCSSSCSSSCSCSSSSSSGKRGNLARLEEHERRDDATGAPGRDGGEREVERGEDEKEGRREDEKKVAMEVEALRHQLKCQEISLLLFEEEKKEEMEREERKRRELEAKMREQGKELERTRQEVSEKEEREKILQQRLQEARDLLDRLAKLRGRQTEQEDRRDGEQAREQKSDGDPEDGKERRSGALFQEDGEEGAEAVEARETPREADREAQTERRLSLCPKCMREEHGGHAEGGEAGSSQQGEEGRREREARTRKLEDELLFQKALLAESEERRRSLEAELVAASTEHQECHDRCVDLQRQHHALETAERRCAHLSEQLKQAERARVSASRAAARALHHAETQLGAAVEARAAREAQLAAEVACARREKEAAERVAAALRERLAAEARRGPDADELREALARERREKESWRERGEAEAKRRRELERQHLRQIAKIEDLHRRRQMQARQLRGEREAAEQLMEERRRMAEAQERRDAEREEAFARRQAQLQASLESLRVLVKQREEENASLARRAEEERERAEAQAEREKERLERLEASLWRLKREGEVSKGLEQDLRAALKTQREEGELLALESVQIRALATRREREKRESEVRRIKTCVALQEKYQTLLVHLAHALVSLQSGGGCDARAESTGKRRTLETDAATGEHERKQRERQDTREECGDGRQTESCKQEGVGHLLRRAFDAIEEAETDMRRLRAELKRLRTKEDTKNRSSSDENGEDDAEHPEGQVSRGRRHSGKVRSRSALPALSVSSSSSFSSPVRPTRCASVHERSSSASSASSSSSSSFSSSGSSSGSSLGFSFSPEAKHALAQGEACMRVGSPESEKEAGDVEETAAGRGVCARCCFLEKQCTALQRSTEAHVEERVLGERREFARKLEAQDEKIQNFLTQIAEQKRLLRQHELHGQQQARLLAEQREELRRFARDVERLREMEKNAGQAWRTRLEKQNEKVLVFVLEALRQYADFFDSVPENPCGNAEGDAGPGSKKREDSRRNGGTHARREGKRARAALPRDSGEEEMPSCSRGSGVHTPQRNASPWGQASERGKSSAGMEEREMGDSHSTRISPLPSPHALEAKLMYSLLSSHGEAEVEACADSSLWPTRKSGTRSGTESETAQARKSRSRSEAASRRASPRSFPSRVSGGSAPRSRDGARSSRSPSPSSAVSASTAGSFLAGRSAARARGDSLCEAEKGAFLLHAERKMVASAAEGLCESFSPEELRRLRQVISRIHELVLRVAASICLWMRRKWRLREILQAMKRHAAQTREERPRQAEEARNRGKTRATSSGTQREQTGSRGRETKDRDDKEEDREDRGEDREDSEEDREDRGEDREDRGEDREDREGDREDSEEEGDWDDKEGDGEDSEEDGEDREEFWVGCHGQTATSTRLAGQDAVGKKGGVTRCIGVPLLRSFSESGPKAARESGRRKENSLPRRLGDSRESSAARFPALGSRPTLPSRACPTLAKEREEAGDKLCSSSGLRQARLPPGLFSIAPRPASFDGVRMPTSTTLPPCTSPPIPSLCPTSSSSSSSASSSSSSSSSSLRLPLPQLPRFSVDDACSASVAFGPPEGEKAETEEETPYFPVLGFDGATSGASSGSTSHAEDRPSLFSSVSSRSSSFASSFASFSCASNLLSSSSFALPPSRRRCLARPAAEKEETERHPRPSSRRWSSSSLRAGRAGEDEEEGLYEEGDLEDSGSVEQERGLEPQHSENETWELERDVPDGTGDRRKGRHGKERGNEREITERGRKERNGDADEEREGAGRQLALSDFLSGSEGDWRHARRERTENERGKTFKGKGSFSLLCEAEKEDASREHETRGNMFAESGVAPTKTKDRSAAH

SEQ ID NO: 889 - protein, 4721 aa, Neospora caninum
MSGQRRTGETGGKPFQLCFSPVESAERLPLLCPCCGDLFRDPTVSSGSLSPGAFSVSSSAAASLPASFALLLPHTVTPHLPLLTSSARRATTRQPWCAAPLEAFSEPCCPRLSAGGSSFSASRAHLGASSGAAFATDVRCTKCGVAIPPLPPAPFLSPASEAPTASSRAPERSGFLSSPPPQLSARIGCESLDGPSLGFAVSLLCALVSSMLRLPSSHPLSCSPPFPEGRGGLSSDSARAVPCREQTETVVSRAARESPPRRQGARPLLGSQQWLVEREREQNAIATALLPLLLLSPKDAMASASVISPSLRDAPPSLSHASSFSAGPRRDEKLTNAGGAEGTATRRDFESESARIQTSCGFRLLHLLRLSVRTVSFSALHGLFPSISSLSSPPRLSSGWASPSLPVRRHRGASGSVSPEKNDNLEVIVDRQERNGVEKETEAAESLRPGFSPKDEAWPWLLPDENAFIGQVGASPSRKLLSFAVHSQDAFLGSLLHPLIVPSAWTSASSSTGSQLSLRSPSSPLRPCADARESGGNALASPSFPEAPAVSRFSADRNLPCLLREAVPHLRLALVLGTGLGRLLESLSLAPSWQTRNDAEAQDAADNAADKDREETVAEESEDEGSDEGDDVICISCCEGFGERLHLARDRAQAMDERKRTSFSNASSAPPASSSPDGLLSLLLSFSSYFSSFVCSSAASSLRTSSSSTSSAAGSLSLSSVRPSHTRRGRGGATRGPCLLYSPSLLVLADALEQRGGTQTHRSCGFSLLSSQSSAPAASAHASPLASLPHPWEPGTALVLTALCMCQRQSWAWPFVPTSSPLSLQSLLFSPSGFSSSSPSLVRFLCEERDVSELHTGQSGDAPLPASLTSSVSGSVPSLSPLSPAAALSLHLLKPALAWLYLAGCSASLVDRGLSDFSPFPSSPSLPSVYKSSSILSTEGPCRVSRPAGASPSAAALSCGRSLAFAMHLFSAVVRRLGLGSGPSALVTLGEDACGGPAGASPIETLFSLFFSPDLSRSTSRWRSLSKTPLPSALLSPSPSPPVSLVSPTAFWRRSCLLLLLGPPTYTRILQVRRRRPPPYSSFVPSSSDSYSVSYSTPATSSFLSASSPGAPSAAGLAGVVAEDADNQRLSRLLLPCFLLHSAFNLRALQEATGLYASSALDWSHICASFVFLFFPDMPHSVAGADAAPVRAPAHRERGARHARAPEANEGRENAARDRSAMVAVFTALLKLAIEGRVADRQTAPVDGPETGYAGEKVSGNRDRPRTAAHAPSDLADAAAEGNAKATTDEFAEKKAARKCESERGHPGDEERTHATVGLRGAGESRVRFSVGRRLEDGAAKNCAKRNKSRFAACDRLLLLTLARLIWALAASQVPPEASLEVPDADSRGVKPFRTAQRGASSHSNSLASCLSSPRLSSLPSFSDATSSPSSAASACSSPASSGRDELEAWTAGRREWLWASFSLLLDAREKLFGSSGSMGLEPNACAEAGERQAKRKKNHEKDGACEGNVTSCHATQSSEEGDSQPLLVIDEDMRVAGVNGEGLGNETAGNVGAKAVGTKPATPAPASRDLRDRARPRRGMRLPSTPAGRTTSLHDDGQGEQGEEEDCDAVDVPDRIASPDASTGLADFVTCHLLEIEELLLHCLFPSFPLPPATRQYLSNYLFLFSSPHELPQFFVSFLLRPPPSLSLGAMDRIFVDGGGDASVDRDARTQRGPGMAPASSPPSAPQAAAPGFTSPERELRWREAKLQNALASSLDKPRGLRALFLCIACAHRGLLGTHAARLIDSLRHAFEQCKRQLELRSLPGEFESGGDVNSTASRPTCRSLPPGAPSSSFPSSCAAVAASPLPSFPAYRSLAWSVGRRVRLPHDVCQVYLGAFRLLFISFSPSTLLFYTPFFLYTLSEFLELKEPAFSSAVKATADKETRTARRGRERTWAPDIRPRPATVGGGNPQESACLAEPFETPESSADCRERASSFESWNMQEAQRLVLLLIRRASQAVGEDGELPPSALFAALACTPVFPAVSDCDAAETTGRSGVSSLSASSQYDWETSTQDRRPTEPPGDEGDNVFFAHVDDNGNPPEMPVVSSASSPPSVGDLDPSAPSSLLPLLSLLPSFLFCPTASLSSLAGAPPLPAASARSEGRRHCMPAGPGALKAVCRVRRCRRFLSFQRRHPLEVLALRLTAIAAFLDDLHPYLTRLSAACLLQKFLLAYGTVLTRLVHAATEKGGTGSASAVCSRVQKGLGQDDVDAARRRVEGERAAIHLLSKSMEPKALPVACVALLGFLLPLVALPSFPSASPSRAPSSSLAALRGEPESLSVSAAAVALLLSSSCPSASALAPAATSGSPFLPPRASKLSPLAPAASAGSGAPLASSAGAGAPTGDCPWRIGDEAQLCCGLLERVLISHLQLPVAACSAQEILRQLGFHIHSEPGKSMRLQRGSRTVLSLFFCLFASGRLELMFPSLVAMFRAEQKSSSVSPSLSSSALSPFFHSSSAPSVSNPFTPAALTALLRFPLESLSPASPSSLTSVNEEASLRAYLWRLVFPPQVRTALLPYCFTSYERTSASVPSFSSHSAASPGLRGPRSGRDAGTNKTNARGKVCGRCGIYIYVVLVLAFCLQLRALPSRRLRAEALTGCSCVSCLCALLSFARCASLSAARRGASPAGLPVFVTWLLHQLQTQLVTLEAAERRQAKAFSEAGAGMEEKASHSDLKPLANERQKSRPKLKSGGSQRSSQRSSSSRSASALTCAGARGTDEVIVLSSSASSSDEERRPSGRKREREAAVSSSAVRRSALRLAIFRACDVVLLQLPKVLSFLLPHMVDSFLSSASDPVKAAEALGRRIAVLLLSSLEGGDYGDVRDVPGEENKAAQRLERDRASEEERERGRPQTGSREIPYGRSDSQAAFQVSRNVKRKKPPPSSDLHTHTHSGAWRYCTRRVFPSFCVHPCRSEGCRVSGQAVFSLFQKLQSWRAWIASHALPRLASRLRPLTEELKSLQNASSPPSVSPVSLAALMSSANDDRGPLGERDVARGPSQKTDDARRQRVVLLSRSIQRYRAQEHRQKAVLQALGRLLESVPSTGLRRRWLPTCSVRSTAAPAWGSWAFLQPFLPLFRLALRRHRPRRRTAPRAPPNPRRLPRHLTNCQVHETLFFASVPLLLSIFRGLHAGDALVGLLETCKCLASVGVADGAASPLSSASAFRGSSPLPSACSGSRGRESRRSERESEGARGENADPRGTASHVEDAQDEEKNRKAARNRHERRDACQDLHSEVARKDAMDGQGDDGALSTTTDDTDVDDLVFDRDERETGSDDSHLDMRAIEKEFQQQWNEAAMLYLQGERKEGSRLRLLSPAGHWAGWFRCVTHAGLKCSSGLWPSLSCLLSLATSEIKARPRHEHDAAAGAERRQQRLQPTARSSPASLPSGFLADAAAACWSLGKWGDLALVLAAASPPASPVSSLSPPPAAHAGTHSRPTDAVESWLSLQHAQLLSLVHQALQRRPRCVGDAPKPPAAEGSLTSTRLQRLPQQERRSPLDSAAPGHKRLAIPGSGLSPASTSLPSPAAVAPACPHRGLAAFLSQAASVHANALRGVSRPLGAALRESPERAAPLLRSMAALCDLSLVLQNAGLPLFSSDSTSVGLSRAPRRVRPVTRPNLCLAPASSQLHDVAENAENEGFLSPFGSRPSLAPSPSLRLPPSIYDQVSVASLLLQRSALSFQTAAPAFAAASALRASQSASFASFHAVLGAGKVALEQTNQLIAAACVGVAIRERARELRSPSLQVPGFLQFSSEDTRCVLSQANALLRRRKGRGSRGAGVGAEDGETSDSIASQDESEAESGVIRELVYRMKVEGVFPFLSRSSGTSDRRTPGLEPPRICFLVALCFVALSVLLVGLPFGCTIRASAVHAGGGKAPSASAPRHHFLLSRLYLKSLAHLSVAASSVSATAHPVSSFPLLPETRNDERASLYHHYSIHRICALVFTFCTPSTFISPHTRLDQSTCEAYAAHLSRLLTDEDAVEGNRISLSLWFLALPQVACRCQHPLLGRDFCEALLAKLLAAFPWRTMWMLASLSNSVAREKEAFAHGVLTVVCFLFFRQQKSRSGPSLPRRAEAQFGCSMSTESLRCLFANSTKLPWTRRFEKKMPCMQTSGTLNSTSKTRHKGRCLRCRCFLRARMIASLSEPSSLASPLPCIALPTLANLRLSPAEASRPKKVTVVGSDGRTYAFLVKNERHGDLRKDSRYCSGTLALQFPSFSLVFLSLKSRSASVSSGPQPVHVFRTMDLAENVNALLAHDPACRAKNLRVRLSSCLLLRPFGLRFLRTFSVVTLSEVTGMIEWVGGLTTLRRCVSSLYSESLPDFAQRSSEVRRRRDVKEKKKKRSQRAMCTCCSDSLLVLLFVSKFFRAFQRAQERRDHQECYRVFTQLGLGRLPPVMQRLFFHWFNEDPARWYCARQNYAHTLALWSTFGFIIGLGDRYAQHGENILVDTADGSVMHVDFDCLLEKGRTLPVPEVVPFRLTQNLVSCLGVTGVEGPFKVAAVEAMNVARQNREILMSILMNFVYDPLVEWRHAGARHAQLQQRKHSSAKPGGESSHSLKEGWERIAYASLVEIDYKLRGGVGGISRSLPSHFPSRLLAGADASTAGGKGRQRSGGTRDVREKEEKEPRGSAGVGSGKPGEKTEGQGNPASEHIQGGGSSSSLPVREQVEAVIQSAMRLDSLARMYVGWVPWL

SEQ ID NO: 890 - protein, 1421 aa, Neospora caninum
MATLRTEREANRQRNLSSSLFSLNTLPSTALPATSSSQFQSSRGRLRTTRSAEGKSSAAVLSQTPPAELRSHDGEKLPDTRAHPRVARTALRNSQNPAACATAAPAGHHSRADFLRATLENRLPNERVSRPRFGGSAPATKERRSASPSVRPSPGFGASREASGSVSRPRRRLLSEPRETRASRLRAQAIEAALRLGKSRESAVRSGDPKLSQLSPRPVRGRQPVRPLLGHPSAPASSQGTSSRPTASEATQVCMHSTHRRTERELRRSQGRSEDRYRRGTSQSQAAPIPPAPGTEPAGDGTRQRLPSEAWPGRDVEPSSSAVRRVPVEGCRETEGQETGSAQQTEPSFSTPIPVHCARPLGFSYSHGRPPLAASRGAAPWKTQLPRSSGPAQTPAGLLTVSASPSRPWLPSSELDGASQPNPFGIESPALASVSCPLPSGRHETRKEDTRGQGSCHSPVHMQREQASGVGTAANGDLFPPSLLGESSAVPASREQPCRSNPDFACHLPEEDEQIPRKKARLTVPSCTEARRVRVERTANADGVSRLQPQRWSSPIHPALQSLPGQSLPSARPFSFLSSLQRCSATRRPVAATLHAESAQRDRLHAEVRRRAVRSDNLPGERTESGPRDWAPPVWTVGTAGRRVRRKGGREIPRIIAARLLSGGPAGLGHVASNQSGQPELKRVAPQPLFNDRSGLPGVEAGGVDSRRLPREGTQVSREETEAQDVRPRPALFSGLQQSLSAVVSFLALSLGAGGGSRPVGEKQQHAVKAEEEARGATNTEAARRGETGDRKARSGELEVERNGEKPERPRPPMSWPFPLSSPKAFARHTVDENRAPSFPNQPHGLCPSPAGVCGASLGADLGDDAVAIGFGPKQQGASLHSSAEASVRSGGAQHGNTLRMATPKPLRSAAERRPGGRTDDSPSLLSRYDEPGAGGPRPAVFGLGCESPQRPHFSEAVADLFLRDSSNSMSQSCSTLHLSSALSSSYLLCGTLSPPLHPVSSSRHPALSSRDRAVPCPAGPGLTQLEATSHPPGLSLPAAISAPPSSPSSFHASGKRRHAHRPYCGKGDPRRRFLMPETERTRCLESSTRSQHVQAVPSGEQDPQGITSPMNRGSIQCVNSFLSPENSPREGRENEGGNNAVPEATRPTFSSSSGLLPGLSHASTSLFPSRSRRACGLSKEIAFHAFENEFPLLTRLAAAQAQKQVRLGSAAVKGFSLHENLTKQGKEREEREFGRSGRDAGEERVKGGGGGKTKRREGSKENGTKMRSPSASSRGFLNEEKVLHANHSPPGLTSLAVAAEGQAEEPRRGTPERTAGERRIEREEWRRLGRVQEQRTVSGRAEAEDAGGGVEGGGEEKKPELSRGNGGDAELGSPLFGDPSSRAQPGRFSSVSEWNIRAGEMAEQMLLLESGERTAKRRKI

SEQ ID NO: 891 - protein, 16227 aa, Neospora caninum
MPSRSNSRGASADPASDALSDADAASSAVPGSASERSFPFVHPSRDQLTADKPAKRDADQEAFAMTEDTLPPVPPAPPPGEEGVPSSRFTSSEAFHDPPASPACASPPRRRCAAASPELEALGAFFARYACCLERVAVVDGAAECPGSLFGCALLPHVEASPAFAVSPAAWTSRWEADPFAWSGQGETRHGGALASRRVERRRPDHRRRAGDCGEKGPKRGARRGRKHGGARAPSRAGPETEPAAASPAASARQRLVQAMALPACAFLDLQAQQPSSFSVSPDGTPDPVYPQDLVSLDALRQGFPCGAPTGKSLGRIQDWSSTGATFWSRRVRAALDAFVLLPSWYGGIENRLLLEEAAVLLANTATCALLEAYAVHCLKRQAAAPIPRMYAAGHAAVSSQSSSFRHYPKSLTSGFSVFFGAGGQLPHPGRAPERPFSAPRVSPAARRVRDVGPAAGALRLWSQENSVFPHAVDFSPGRSEPQLSLDAGTGQCGDLGGEFGLCAVPAFLLGSRLPLGSFFSSLATSPHLLPLLLLRSHLGSLETGVFFPGGSAASSDRMGNRTATETPALAAVCSDFLSPSTLLDTSTFHERSRRGLREEERRRALAGAAGEPGEDDFFQLLLGSLGPERSRNLVAWSVAETDAFYLRCVYTLKTIVNLYMRFPPLFFFPRSMRGEDSQKQRTNGPDAGGDDSAASSAFPSHQQRLWALLLVILSGASPLSTDEGRQGGDSRADGDTLAAHFCPGEAVSGKREGRHASREPTPFAFGDAGGRAQDRRLGVRLTKTAAGSTLRLVAEALLCSALRNGCMSDILLTILVCLRQAVCDFQQASSAGLSAESAARPLISSYSTASQPPARPRGIPPNSKRWGSHYLEEFQLLTLFDDLSWTTEPSGLESGPDSPSLLLSSDRRAVEFVGKAADAVPLSRGSSGVSSDLARSPRPPGPRQGSSSSAGEAGTRRTASPLQIDSERVRDADSAVGRTAPAAHPPAPDSDEASGGAEAEAGEPRHRTAETGDSLEFLEVEDGIGGSPGRHAFGRDSSEGSGASSEGASSFLTSSSSRCQPSSVSSDLEEAPHWRPRNESETSSPRRREGRRDGPSGRARALRCSRASPTWVDDARGTRHARDDSSSSAGTSEGSQSVGTGSLGRGHLSARADSRRNATREAESDPEDREGARGGASLIGGRRPRRWLAPAAADILFVESRGAADRGPARDDGDEGDDAGAHAHRRHRGEATTFMTPVGVRVRSSQANCESASLVAARLTEDSRSHTITYFQLPSGVEPEDFDLISDIPAVSWPLVSQTRLDLPQGDSGLGTGSGSSSSLARRRSRARGDGEGVSGFPSSDCVDARVVCRYTAAFPSSSHSRTADWCGVPSARGRWGAQFLSEGCLPFASSPSVVDDLEARLENEAANPLVPSPNAWSPAEGVAARFLSQTLQGELLDALAEPVCTITHTVAPRAPRGSLLGPPVGPPVSRLERPRAVGSAHDPTRALAPQIASASLSPTRSDDDEIPARQTPRHQRDARRGDSSLPRASAPRSGRTAGGSRAPSEGLRTLQQLQRQQRRARLAATREAFLTGVHVCQLLVCEKISSALLAEGVVEPGRWRPASDALVEVGVLLGDAHLAPYSATRVRTRGPPPVSRSRNAGEPAHPGGSSEDAEVKENAGSSSDRAGRGARDQQTGGRDACGRPDAAQDSCMQSGGSKETTWQEKLYCRRAAGGGENRLGGTLCGRPGACGIRCDGLAWTEWGEARSARHGRASRAQGDCRRDETETRRRARGTGERGGYLHLGRRWTEAMRQGERLEGGKRIWCMTLMLNIEEGELDVFLDGKLLHTFGRLPNVSSACRGSEDSSSPLTSTLGYRFAVSLSSPSHVVGLVPLPRLSPAELDRLLNHHYRSSRALLPPADWTTKHPGALMASLSHAALRLSLKAKLTRDARAAVRGAAATATCLSPIFARGGGDSRDSRESGGAPRREETAEASSKGEASASAAPAIHIGGAGLTEWIKADGVTLDLLRECLGLAWDLLCRRAMHAAAEKERCQVAGGSGKEPDGTARAAGRLVDAQNGSATAPSVGAQGDGARGQAGDHKAGSESRGVKKTDSSSALPCPVVSPRSTFDDDAAMGTFYCLLRLWALLLPSAPLPPASKDASHPASSAVCQPWNTAPRPCARDPVDPLWLRDVLVRVVSSAASQPHAGAPPSTRDCEAWADLPLPVFALAAASRPGAWLVSPRDQLEGLVESRRVNREDESGEGTETPGGETVHTPTQRLAGGSRPRLDAAFCSRVLSLAPRWRRLVVSAAAEASTLTFCRALLLAPFLVTEGLDKCFCSLAFLRVAHRSFLEGDEAAGKEDVANLEAAAGAPVSHASPQPACALLEDAGEAGTWAQEAGGEEEARRDAETKEKDRDGDPEAEASAGGLDQLLCATLPAVVAALEDFHACVYAPLLPGGLRECPHSPSRDGRRARPVDSPESSGSFERGKHSSADAAPRPSSLCGFELASLASRVFAALGVLGTDGGVIALATAHCPPFLLLRLLRALLALACPPASVLLDCRETPALAAGRAYREDGAPGARGQSEAARRGESIPQVQGSERNAGPVLDAVGRLTRLVVRPLRRLLLQFFLCVRREFLHAIAEEKEEQMKRKSDCERRQLSQLFGRQARAAARHSPGNRREKGERTSGREGELAGGNFGSEASERARQGLTSTGGPRDELANRRESSPHPPRGFYVGSLADSDPGERDEDVDRPPDQVGDGSRSFVPVRVSRRAHPHPNRSEGEESGGAKTAEDSLPETPGPFLDPAHETPRRRLLPSISASSRPLRDKLDLHLDLLTAATELTFDALSSEAEQLSVPLPSFSSSQGASFAEGSVRLRLKCSERLLARVCKLVVYQIFLLIKFRKQQLFLAVLPFMSHTFLSERESRAESQLVRLLGRLDVFLVSLLPRLLQFAGRLTQAAVYADLVVALCTSGAPDCLLLQASRCDRRDRVETLAAETQAEALEAEATAAGDSGDADEPPAGVAEEETAVNRLSEGQTSAKDSAGAAVLVCWPDALPALCEALEGRGGRSRQRPRTPGRRRNPPTASPSSSGGEESDTGSVDEDRSWLRESLFMLPTASTAYRRLSQETCCVYLLETTHPLSTVADFRLCLDFARLFSTSQRPLQASSPRLAPTRSADASPGGTGAHASSASAPRDSGSAGAESLDADQRVFFGVSQADSAPGVLREGEGFLGLEAGMAPGLAHWLREDEEELCRGEGAQRVKIKFDPRSNTCDSGAELHIRVVTCHGVKTHQCFERNFPKLKFRDVKSIEFDFGAAYPSVDWGFRCQVEAYRKSSRHATHPSLELLLVAYDASFTLIHHLVEDLSPFLSPVSPPSSSTRGSPSFGAAAFAAAVDALRPLLLSQELVFSRPSTSAPSVRLFGPQSRASPSSPCSLFPSSLFPSLAADAAPTGCLVPWTECARSLYVAASEVRRIALDCSAAAQDGLSSPPHLPALFASHEHSLLSSLSPSGSSAVSSSTGRSVSPSSSSGRLNVALIDFVHGRSQVAKAIIALGDRFFSSPLSRTAGPPLLPGGFAHMAAAERAILALSLLLQPAAADLFLSLLSAIQDEAHLEAGDGAASEPRGKETENGAKGAALSGSHRSPAETRPPEEFSDASAASPFPAASPFPAASPFPAASPFPAASPFPAAPPVRELPRALQLLWRLAAQTARLAVHKGAQRFSSLRSEATEPGGRDGARPSLQATHKPALARRIAKNALFLLAWMRLSPTAWAARKKQRFAADRPLPLDPMSLRAWLLNDTTLQAVLRVALKPCSEGAALASPASQLKHFGLAVDLWNSYNARLRLAAEALIFVLEGLQTTVSLQGVLKRCRRGLGATEASEEQADAEATEAGEAQRRPRGSRRRHEKRMPPENGECIQWEGYARVGELSCLAVDASWRLLRFLDSLAETLLGTRKDAKCALVPLAAPSALPRCFVTDYERLLRPVLSFCGAPFAPAQTSASSFSPLALPGLPQFLLQTVLLSSSPSSFSSLLNEGSFALHASPADPSSSGASAPFAGSAALVAALCGVTETLSRFLFLSPSGPSQPPSVFNPSYPYGFTSQVAALSRAWLAPFLLSLLVLVTSSRCLRLQALGLWAAKQPKDRKEKDALPEEAAFPGDWRSRRRLLDAELLHETTEQARRVLRCVQTVVDATGVGLRRFLEWQTPKRHIRIPNFGPPAASLTEVPNGSLGESRTDEGGFWGAARRDLPRPDACRVSKLRAHAPNRYEGDAEGSCPPSSQGIRRRPASTLSQGSHVRLGRPPESSLDSLSAPQSRTRRAPTGERALSTRGLPFSPDRAAFPLSYLPPRGLPPVSYSDALVEVALVFVPCLSASRDSSRRLPASPSLRAFAQRSAAPGTHAAALLSIPAHGPVSKMLTRHFRKVDQCVVFVDAGGEDDMEIERESQANKEANAGWKPPTCDASRSTPLHQSRSESGAQPALLASSSSSPLSASAATTPHASRPLKPGQPVRVELWVRTAGQAFADLLASDGPPGGSDVYAGQRLAGSSSRHRGRRVRHSCYALVTKKKAAETLHTDRRQDGLWSGDSQAVPHAAGERRTADGDSGGSSAARLGRHPVASVTGSGEIAEDHVGVFPSRRREEGGDSDRPAFVHRGRGQPLWTQADPPPSGGGLESVPEGASGPVGDAGGCEGTGPNTRRTPSMRARFLSGEAEPSPAHWGTSAFLLAGDAPAGEAGRSARQPRALGESRERAEGVSSTRAEGGEAPAPDAPGGSGDSGGETERETDQVWWHGGPESATTTKIVQLAETKGGAPKWMGTVPFVRLLVPDTQAWHAAAKRALLSKTPRLISCSGDRMPSGGVQVSRAVVARVRLSRDEERAWAEAQRARNGEANKRAGRQVPALIVAEMGHVSELTADQVQRDFESHIRALADSNADPARRSPSPNPRRRLDTLPASSSSAVCTSAAFSASSSNSASHSEAGASAASTAGRRSARGGFAPTPRSEKVLTLRQQCCAALQTLDALGMQRTWLHATAAVSEYLWMSFRAAVGLALGPHVRLISHFLAAQSPSAPREAQEPCRGVQQSEDAGETASGRKQGRNTRGPRGRQEDRHAVSPQRSSLGALSPVGACLKHFARLLLWSVEHLEHASAKIGQGEATGGRRPRPGPSAGERGESTGTAEKARRKAGLARERNASCLSLSACLRRVLAGGCSSGSATDSDSESSNVPSTPPLPSAGPAPVAALMLRLLDVASGLSIDVEKRSPTPQISSRAAASPADPSPSSPLASASACFRASQGSAETASLSGEFSSDGSPSSGRSPLLGLHIAVQRYFHLTPTKAPPLLPEMLLSGLGLGSSYLADLLWHTTLQRQPASPPFSPGPPGASAASSPISGNEGVVVNRCRLSPACLPALHAALSANRRLLAILDHAEGERGFRAPGEGAECDQGGDGRATRERRTAPANGASSRSDERQTEARRKRRRPKTLQPGGGASEPDEAHTVSGGCSRSSAGAQAQRRAEGSRGEAALEGKGREESQRPGRAVETKAGPWVTWTEQRSLCLTAETIAVALLQLLQWVVEFRGVDREDEDDCHVQALWGTVSADGAWADSGCCLSQPGASPQPDSECETDADAPTPVGSRRRGPGGAHERLWMANLLPRLLATSVWGRPYLGRCAFRFLRLLLLARLRCVLFASSSPSVAVGTVDDTGQLRRRLGAVAAILPEPAVLAPLLPAPPAWLFWDLTGLGVSPDKPREDPVPPGGDETAGLAGEVDAEIDRTPGGFGDEHGRWMQTKWEKTRTVPGRRSATDLPQADGERTETQCTLSGGEELAVPTHAVSDSRTESETVPFSLASSPAQFEKAKRREEARLAAPSLSPAARCPSVLWSAPSLLQPVVLRASLPLPLAGPCWYRLAVKPGCGWFKLTALNGFSVRRICLGQAKQSGIKHADLMACIGLEVPTLRAGKDFGFKSQVTPLGQALTALERETLQKPSGFPIPTASFMDIITLAKPEKNVLKIRVDGKGMWNVPLLHPHVKINIASSSQTPSPGSLRRKAGDRGPRAQRAERPDRDATGHGRRAASRAVFEGGERAEKTTKRPAFAAAPFESTRKRRGVDRSLPQLSTMHELHLCIVTQVCSKDAFQLYVHRGGGEIDKSLRHHRKLNGLLRRVSHLHSTGLRGMAALETDPFLSDFWPVPLHQLPALPACNGPATLAFSAYALPSPSTFSPLLYRAPVSRALPASASTFPPDSSSLPGHVEPLLPSGSSAKIVDVAQASANSFTPSDASAALWETRRRELGVFASRAFDSHAHLLRWRWTCLFGDTLLLRQSVHLRRALLLGDLSLRTAKRQLLGERRREPADPTNGARNHRGQVAPSAAGGAAAGLAEPRRALVCDGEEPRSEGVGRSLLSGKTDVSSSPRRDANHREDAEGNGDNERASPQRDEEEVLGELLADVLNALADGLAEMEAWTTQGVRPQPLPFLALLSSSPSGVSFSSQRNATDLPSGLLGEGSKEATAREKSREGETAEIASQLAPSPARFFHFAHTQASAEALNRLRQVFSRLSALLRLFVFDGAAEDAESPTDGLPNVTGESPFTDFERLWLSGTFQRRLCESLLEPGNSEGRGGPESSRKKRDDPTFEHVFARSWFPRGVRATNYWQILTELSSPFFSEHRLWRPFFLLNAPESAEPERGLAARFGPVGAPLRRPWKPRSLARPTGPDTQNKDERAETAARGTEMPRSTPESPAGAAPRARSEPDRAGAGAAASGNCSLPVSSRVPEQGCSPEERRPERSHGQADWRDLWAMACDMKNAEDGAFLTCLVRLLPSSGRRLLLQKLRGNIQQILALCAKCGDLHADAADLPQHACFSEARLMRLSLLASCLSVLGAAEAATAVAHREMVQREEDGASEATVAEVETKRETENLDEGAAAHVARAAGGKVEEIRDTPRSPPSRSGRGRNTSLSSSAKVRDEREDDSATAKVTLALLTAVAPLVAASAPFLRRRSCHSEPAPSLNRLGCVADVAQLCAVKADVLLQRFQLLSYLSQASGYAALSVPLTPPLPPSSSAPARAAAGAAREAEKPGKGKGEEARDTATRASGHGSTDDEHPQPEKGGKGGMERKKRSADEARRRQVDGATCACCGVPIAEPSKANAKKAKRESPRRASSVSACATSPGGGLVTNPAALLSSAKAGAETVTVNSQPEGNLGDERGRDDLAARIQTGGFESMRQELLDAYDRPWEPSRRPALIRVALLTDLLESWRFLPPPGSSARHAFFSLLLRLSRATARVLDPRRRDYGEDPDGDSGDAAVASAVGRAADLDRELWEGAVTWPQVFWLFDQMPRFLPVADSSRWTSSEVTASVLNRLASAVSLSASAASDAASSASTAQNQARELPLTLAGTWGLYASSDDIFRLGPDPSAISSRAFLRLHGYASSCITNTPLASSACSSFSALASGSSLPLLHCDVDSADRSQHSTFWKPVVTDLEEVRGHPLDPVDLANHFFMGEFTRDGSSLQHAALAGGSGRVTGGGGAPRGPGGAGGARGDAPAGIAAGGVVEGDEEDASAVHHSPLAGGGGILVGHRPPGAGRSDDGASYPTHALFEVEADSVGSWSDQSEDDEEAMAAASGGHARGSRAPGRPGDSGGRLEGEGDDGRPEGRRRGSAGRDGGRRSGGRASLAGGDGSARSGGRRGLEVLMFASSEEEEDERAGLGDERGDSRRGRFDRIRILAEDDPRDLDEATELLTDEGETELAEVLPGDDDEPLECDAFECDDPLQGLLYENREVMEDLASMNLAFRSMPPLFRPVLASRLVPSLLVRPLWDRFSSEGYCASASDRQNRFPGGDEIRGADMGNAAGVVERRRNPRARDAASGEGHFLPCRDEEDESPSLRLAMVVHGGTGQMRHFEAGLDGEARAQVLLERPSASLPSAASTSEASRVISFVERYRRIAEGHGSYRTVYTADSQRQPDGSPAVAHFRVDRSAGLVPGADSRAERVRPEPPSWRRQRGVYEETRQLLAADGWRGRGGRLEASEPGLSEAEAGWRVQSGQSGERGSGRNGEAGFPPPGCSSFSFGSSSSDSASEDASLFDSEDDALSDGAVVVAHVLRPLERPLGGAAANRSGSVPRGREAREDQRRRRGYPRPRACSEGGGTCLGSFPPLQRSLSSHVFLSSATQNGRTHFAHSSSSSFSSSLGLQDSNNGWLPDIAWLRGSCADAGFDRLESLDRLESLDRLDASAAQSGLSPPLSASRAFRTLPVQDPPLLRSPSSSSCSALASRASAPACRLGGEDEGDAHKLCCAICAWPLCAGPAISDEAFAAAQRQFARRQRGVRPSRRRRWRKGRERSGRAAGGEKEIAETTDGHGYDGEDELGTVSDVSQTGEKAFVLGASESNVRWLLASSAAFSTAPRTWLVRSRPLPRSSLAHGRFAELKVGESAHEESSFSATAHSDFPSLSVAGEHEARDGGAHLVPQANGEARKARETQEEKATTVDPSAVVVAPTKANELTRVTGHAVEAHSREAFSRITKFSHKSTRAQCRQSVEAAGGDLRGDVRTPTDLHDLPLVSASLRETSPVLLPSFSTLAPLPVSRQALTPQFVLDARQAASDGEADTRVFRSPRFRRVCSFRRKTQQLAGDERRRTPRTEILASMDDQKVGVNGTDVNGVADEAAAGKARRETESVDSGHGGRYKKPAGGPGKGRVGRRSGDPSAQFPCAICRYRGFTCSAQATFTSRLRGPSDNERRFPLWWLQGSFSTARGPRHKTSHAASLAHVGDDGGRATWPETPEWIPLFSRFTAAVARCRRPSFSQVDLEGSGTAQLSGGDRMPSPLPLRPRTLSSVYLPSRRSACLSASVAGGNVRAASAFFARDQKSFRRAGKRSATPGSAQRALDKESERGPALRSPQVRALRSGRLSSAQDGKSRLAQDHGSKRQGGAKGMKPFDSEKACFPPVDSEAARSFSLPSGHAGTPGAFSSLGELHRLFWRQYYAAQDEALLLMLAPFLGGNPVSLSNSWPGGRAFFAANDVPEDIELSSLADVRCPRCGKTLKNIQGSGFEGKWRCDGLDQNGFCVASLTDYRLWSAAARHRCHSDDFDYCQACFEYKARLNARKLKWLSTNSSRLLWPSHRPACPSGPFLWQLGSPRLPEEHRRRAEEAQRRIEALVKKARERQERPEVKADSAGDRRPELGEERKSGKPESRKASTAETDWRGTRDDAREPKGDRGRDPEEIVSRNASASSGPLPRRSRRGERERGSLAFHRSSSCASSAASSGLPSLWRGPERLPAVQSPQACMQSWIREATQLPLLAQRPRSSSGNGEEVVLRDGVVLLIPSRLPYLPPPPCNPVLLDGLLTSAPGFPESLAHRLLRLGCTCLLPLFFKNFETLRIHGSRVLPAAAASDAAAGDALQAVGEASGSGIAYPPPFPATARERRPDGAQPRGGDSRRPAGGEKASRPATHLTVSLVAEEAVWPLVIQGRFAGSGDCRSIPHLKKDIADHTHCETEGVLLSCFQNGRWHGAARREETLRDGGDGANRGQGDFLCGPFNRQMDGQGDGKWFIDVHKAQRDPQHYKGTVGYNGSVGYWNLDTDVPGHVAPAFLAVSGHACTPEVRNKAILFVSSLQRHLEVFLPANQDELEAQMNFLTEAAESLHAAGRTGEGRAESTESEDQAGERGRRCPDRTQNATKETPREDDADDVAEADEAPERRKTGKRATGSKAPTKGRSRGDAERCDASEVRASARSPSHRPGEGEQPVDVGNCAVSSGEAFEVHLCPACELQQQAPGDSLQRSERAARERIVNPRASSASGLSVEEEDEYLALKAWEANADPLAAALLPVDALQRQQMSAAVRCYQWETALQSQNALVQLWLLYPSLALDSWPLVLRFIYDAVRARPSMHRVLVELLLAVVKAAAVQGRRRDDTEEGTTDTSSDADSSEEESAEGDGFDGRLLGRGSERLESRGTGSMGAFTSSRFFSPLLPSLSSSVLTSSRDRDRETDGGRAIASHLGALALLHLAAIGLLDRHSAEQAEAYRVYRAGRQQQLALQSVSAQSEDACSPLEGVAFEALSQRLHLDGAAGHFVSLGLSRAPHGDPDGAGDGARARAGVSVSQLFRTQEETQNAARERGAQRRREGNREAKQETSSLLPESRVYAGIAYGVHRPWPAACSRDIFSLSPQPIVESDASTTPRASSLSAGAPSVPSPDCDGGSDAARGSGELPSSDEEEGRDRERRVRREPDDASRPWRVADPRPRLPVAFCRFQEFAGGAGQSGAAQQLKYLNPALLVDCLHSESRHPYRPTERGGRKTQVGVEEFILSRPVNGRRRGEKRRGAGEAGDGERAEGAAGSAANREERRDKNSPEKVAVDRRRQGRETKGNISVDIAMDPGFDWARGFLIRFSRMSCTRPGDSLRFYAHPADDICVAACSGASERPWTSPVFLPGFRFSYAFHPFGLNSPSAPLPNPMCGSNSAGLWMSPEFTPLTFASPANDLRADDAAAARSAELEAVERERNGREEHGCGARTAQSDERAAAARYPYPSLHASGAPPRTRSAQRAVDANGGPVEGARRRGRLYTQSASMLEAARGGRATATDLDSHATGNCGVEATESRPDGGTEKPRRRLSDRGIEEMEPAHAMWGWKFVVSVANRAEVLQHYTNLPAPFPSPAAGRALLEAFPGTQERTSRSVAETGDKGAVPKPRGAHASGGKPRKKRRRRAESAFRSLQSSLFLDLFQPSVDLTFIRWLVEDVGGHPEVREQAQTRAAVSLLTSRSEDTPLTETFPDSASDSGASTAGGERQKDAREPGAGARNARELRTDAKWREERAVRASLAHLLACVYHPNVFQALVGLAGSCATLEGCGPALQPAAVFLVKRFSQLAPWLQGPPRTHPQRQRRLRAQARRVHCDDPSATSSCLADSERHPEVQLGSPFWLSSQESPSPCTVGRREPGGTNTPGLNCLETCTSSRLSPPSSARSCGSAAPALHASSPSSPLRVLPETSEGSLGPQTPSRSFSPQATAPAIWSRDAGSSSESSSPDAACSLALASSSQQRDERDAERDVAPAEDEALALSARMRFFFLLLFMEIAAQIRVPRVADSVFESAGVNSMYTSQSETQGGSSALPLSSLPPRPRPLRPTQQIILPPLAEYVGQVLAVLFSACKCAAACGECGAEAREANRRRQLSAQRVTWRLSDIRLLCEKAEREPRSNPSRTSRLDGPSSPRCRSPFSAFASEADPSNAGGRRAHPPRSVSTAGSNRLSRSTPSCPEEPHTTSATLSSPFSACGDRPHDHSYQNSYPAFRSQSPSGPASSFGPASSSPPPLASSDSPPSQCSVSLLSRWSCGDTRGVSSSASRDTRWCPHAASSPLWLQPGPVPLHGGGQPPCEAPASSGCVGGTGFCVEQAVKELLLQCKVLQDLRGLEGNLPHSQGVPFALFLFEFLQRLTALRGVERSRLGNETFWECKRRLGAEGPGEGAARSEVCGRARQRGPDPSQSTGGSLAVSDAFWNGQYLLDGRKCRGCPGDARSSDRFEVDFERFLPLLDEESQHMLLPEHLDLRKALWPTLWRIAEKRRQLARTRKALAGTHPTARGPAMEPQLGGQQASVAQRAGGQGGDGSGATDARTHALERGNASRPAAANLGLSTPASFSISPSFSLREAEGAGGDASEADLARDSRRRGSERPLSARNQCEGGDSSPRTGRVLPESASSPVLSVPPQWLSTERGEAAHISGRMQDSRDRSDVPVCLSSPLQLSSASHSFQSYTPYKIAFSASSPLALPLLAGLGSPSVASDALEAILPVSALDESTSCQARRAGQSKRGIGEADEGARHPPRALTAPALPLAHARPGAVPVFSPLAVRLDARELRRRLCLRWGVGPRSGAIGDGRAEPDSLGGGVCLSDVRALDSFAASAQTSRQALASWALERGDSGEERTEGCEAGDSGKGHPPFTSDPVAFLSRELALCFEADVRTIDLSPYAAGAVISFCSSPSQLAPGDLLTVYARPRGAFCTRSRAPGPQSSRVSPAASVSPPSPWIPVVEMSNYHADCLWYATDYSPSLSPQLFFPAGSPPSPHWPEEPSIANTRPRLRDGDKERDRGTGYFALGSLAAAVRLGLLDATEAAPFCPASLTKREERTKDDVCAGSDGAQKSPCFRGDSDAHVAGKAARPLDAARALATAAGALAIETTPLEGFPEEERRVRGEAKLAASMESAQVLFSRPASFLWRLPPSLAHAPSVNEDQNSGLGLGTEKRVETRFLKNAVGLLTERDEDVWGTVRRLASHSSLARPLPSHLASPLPVSSRGQPSQPTALPDRSRSFSSASLSSASSLVLPAPGSSSRAPHPPVPRSYQRRGSGHPTPAAAPPAQFTRSGTRSRTFSGTSVGRSGSFGALTGGLSSLPTTAGRRSSYCAPTSSATSAATPSASSLVGAFASQNPVFAMALERGRDERRRDREAREEPDAGGSGAVPASSSSGLCRRGRRHGSLAEAARGGLQGEGRRRGSSGDALLALSSLGETPQALSWGSSSATALLPGRGGRSAGACMRRGSFAGRTATAQPFGKESSFSSDGGSQRGSAEASVRVSGLPSHVGAAPTDEARQNRDEARVGASDTIHLVSGALIPRDEFLRAGVWRVEFTVGWRQNGKNQPLLAPDEGSLPALPRCTGGDEDGQREDALGWHAGPEFGWAPLTHAVSPEEAAVDALLSELLGTRSRTTRSAETAEKRSDPKGVEKRPEPAEAGTRSSDDGRTSTNAQIASEADSQSRNSPLTRLSSASSPPSAAPSFTVPPPASRYFWLSCTTQVVSGSGVVSPTPRREAEGAWASVSGSRRNRSCLSSLSPHQPQAPHAAAPATEAAADAGYLSLSAVGKAPPRFDRDEETQERRGDSDGEAQEPCVASRLTLGPGDFHSHPFIPDPPIYQRTFALAEHLNRSYPPQSFTPPCYRVLPSPGLLRSPSPPSSAPRSSFSSLSSSLSPAASGGVCVHPVTSGEPRVAAYSDVMARVHAHHQQLRPSQAEVRGVWCVSPHGKQTVQDTVVAGDWIDSQSVAAVLTACASGLHPEAAEERACSGSGARRDRSVGGDTEDAPTGEGFCRDDAQLWERNAEGRNWAFSGPALAERLTPEDVLSRAEVLCSASSRRLLHFGRSLELSPSRACSAASEFPSRSESPVTGASGGDVETEELRTLRGRRTRFSPGRPQAERGRAPLLEKEDQSRREDSNSPAPHLAGARGGLAGRGSSRGFQDEGPPRNGIDLGGGGEGDNAGANGEASQPRRGEDEGDQVERRRARRDATQRGDEATRRSALRGEIENHFLEREKQSPETGRSYFRTSKLTMELSFTPDLDRLRDLHAAFADLNTAMAEAHTLLASSPPSSCSSSSSPSSFAGSCSGAVSVPSSSEARQAMAARVARLVKRVQMLQQLGPRDEVRCSFRVESPESERGSKPNQEDETQSEKYNMTWHVGGLKSLLGAGRGVALCPAVKLGPCATMLQVTRVHQPCPAPRTLSLVNCPALLVTHCSSLKICLSPSPYRTHRDWRLLNALPADAFLDSFAPRNARLVLLGKGRERLRPARGAGRSGRQALESRRWGKATERADRTQKETSSQAASGVSPSPAGAPDQAGENVAVDEHGEHGQGRRAWRRPACGGETAGEPAGRSTARRGSAAEREASGKRGASGERLSVEPQWREHGEHEGEGVAARKEIVDKKNQGKGRREENGGERGSRLAHAAEACSSSLPPPLSAVDPRPSPSSSPGPSFSSLHAGRSFPRALPGEAGDAVRQGGLGSGGATAHQRVEGMKPSLSSPELRWGTAANEDQFRCFFAPFPAFRPVSQSATRRRDGATDAPLLQPTPNALPHFASRLPECGVASRGLDVHSGAEGGPGLHATRRRHSREAACLPWGRQPRGDAARKGPTDGERSERSLVGSQDRQRRMSAVEASSEAGFSPFASSNFDADGCCFEGLGDANPGQTGPRREGTGDTPEGSGVLPSWESILFEQDQGLTYVGPPGAWWRDPERLSGVSSTARGRSAEAESARETEASERYEGWRLLVRQLIPAGHQVNAALAAEEAVGGELAAAAGQLAHALLLNDESRARRRRRNPETSSLGFYSSRAGGKTPSAQDLPAAPGEEGEERSSDRLSRAWQEPQEECSASREGGETESKVASESVASAERGSNEERRDEIRDSAKVEASGASERASRSPNFGDAESNASLLLSVTPSESPSSSQSVALFSHSGDVSQSRVSLRSSPNAPPLAQRPPGRSQPASASESVAASFFGASEMSRGSEPHFASVQEGLLAPSQSLSRFAQASGSPASPPLVHPSSTSAPPASGDEGLLSASPESAPRSLRAPLAGDGPSSGRHALVSDSLSESRSATDASAARDAASLSASPLWQLPVSFSPSVLASLGRGRVSGLLPESGPQRGLHARKRTLWKALKAALRCARIRVPLQGVVRDLEVRVGVQSQPWPDELLQQLVDIAAKGNASLRDPKTGPAVRPLPPLLLPLGGSATSPEATGECEVVARTTVEGSHPRPSRRKPGDGEVANADRVPPGDVGRGPSSLGGLGLDPGRLLSDSTLFCVSSSLPSLPSCASDASPSAFPLDCSDPPHASFSPESPACVVRPFQSAVSPDGALRVSPLDIWTWHLPFFPGLSSDAVAAWLLRAQKGQVRRATERAREAREAQNRDRRGRQGAGGLAGEAGEEGTRARRRQEGQGRDASQVEAEEDSGQGTLGGRRRRHPLVGSPVHEGDRSGDSGASEPSTESPFGAEASASPPRLRSAEASESPRFFVDPDEGFSDGDVTGDEAPEERDGRIFWDDVDTESEHPWPEVAPDASLAYSEPYFTEDYADDGFQRDWRLEDGFEAQDAGQETLVPREDAPMSRVSSGPSDGRGRDGGAASLPGAALPPASGPSGSSGGGDAEEERSSAEEDEDDVEDAIADEGEPLHPPGGVSGIASSASDVFTRGYVSAVDQLASELWMLYEVLVLRECVKRVASAERRKRERGERHQAQRHGASRDRQIRSPSAASPAVGGVSAATRDGASESQAESAGIGRARAEAPETERESPRRQRGRQAESGQTHRSTLSSFPYYEGALAAIEEDEATVLFDRPSSPQSGPTRDAFGRGGLEDTRGEDAMGDSEARSSGRVEAEASSERERLPQPRSFLTGSPPIYTAVASPLVELPSFCSPLLYQVLYEILLLFLRFGLARCAARRSSSARDLLRYWPPTVGDLRVALQLRLRYLHQVNVSFLFLSPFLPTVPPPYPYLYEERHEVHLGLAPAASLRGDSHARDGAETEEWGSGRSMRSSDPVAFSWSPTSHTGGGLLTRGGRIGKTPTGGLRARAAWGLRRLPPLAFRTRNETARSLRDAEENLNACQRDAEHDGGFRGEGTQQPADGRLRPPAESASLRVLPESLSSSPVSLWGPGSGEEREDCEDRDKVLVALSGTKALLLPAVKNFLFRASTIYRVHAIRQQILRLPGFTYAFRQPERPRQALAGDTSLLPALPSLRTPAASANSPALSGFLGLSRGAGVSAPRMSLAWEATVSLIRLHAPLEDIYVASARSGSLLSQGRSGSSATLVVDVTAPLPEAWGNVGGAAVLLDRNATRQTEAEGPAVVSGAADLQTAQIPGVDTPGSRGGAGWGGEPGDAATGELEPADGRLPGDTRLEKSLTVQLAKQLQHVDALKLVARERAFVVQLRGEGAQDLGGPYAEILSNLCDDLVTQKLVVECPNARNSVGNNRDVWILNPRLREFLLGADASALPGVQTAHPVGGWGPSGASGTSGADDAHRDAEDREGDFLSGAWRGFESHSRSGEAEDIVALGCQGPSDLGSPEASSASRWAPNLSPLPVLPLFPAEALAVPSLAGALDAECVDACGLFGFFAPSTSSAILSGCRRRFDPSHGVAGSAGAARFESETPNRRLRDRARASWRAWEANEEREDRTCFRLSSYGQHLASALFVVGRLMACAVLTQSPLNLSLSPSLWKLLLLQLPALQDVHAVDSLAAKQLKTFLACCGLAHRRRASPASAEREKRGDEDLGNASEATESQSVSRVDADRDKATLQAFAQNGWAVDDALGRNVELFLGGARCPVDDEDIADAVQAALLAKLTEGHEAAAWIAYGLYDLLPLPQVQATLTADDLRQLVCGDDDIAVAVLMRHSKVTWDNNDARERALIDNLWEVLSAFTKKEKQMFLRFVSGRSRLPRSWVSGDPSASPHKFEIHVMRDEEALEIQDASLRSVQIAENQTVDDRLPTASTCFFMIKLPKYSSKEVLRKKLKLAIMSCVDIDLDALHHDLDFAQFE

SEQ ID NO: 892 - protein, 1988 aa, Neospora caninum
MSLELQFKHPSLPYWLPVNHPLLPSCLHVSQPVPSSSALDGKCRGALLESFRFSGTATQADAGEQGLHTRLSDPGQAQKEGGFVGEQESKARLKWASARSRCACSLVPPQETLQSPDIDLLRLGPSQQIVFGRKPGLDSSPVSSLSSTSIPSLSSSPDLSSFAAFRFAADPLYRTGNLLAKPGDVSRPRAKLRRSAASQGSPVSFSEAENFFGSQPSDRAESSLPPLSSGRRSEWPNPCSRPSTQPSDCERSPLPCEPCPAKGRKVPIHDDPTDEGKALLSGRSRPPRHSEDVLSCWRRSSGSSASPYSEARERVSPALRKDGTRERPASLCPVQTVYLPSLDPLLSRQHFCVTRIASGASEGNPKLCEAGESSETQFPRFVLTSKAAAREATCREGKREDLDPRAAAINKTFEQGLQGLVLVNSSSALSAPLDLRSRLGLLAPTVRAAVEAAIDASEASEQHAESRFFSPCGRGLPPGGTAHARSLDGRDRSATAPGSNNDPSRAPRCTYTHFVYQPHFLQDGDQIYIPVDDAFLKKPCKADTLGSAKKENCQRLSNASTGTEHDPDRPHGLSRHAASGPRSSTLEMPSTSVCRSCGEATPLFCFRYVFHAAAHPSADSSRPMLSEASSLSSAASSLVASSPPSGPASTASPSASLPVSVESSFFSFFESHASSSPLSSSAAAPTRSSASLPSTVSAVETHPLPGSSSPPCGASSLSSPSPHPARFGSSIAGKLGWSSADSHDRSAPRWRHKEHECACDRTVSRETLGTRHAADGPSFSESRPLPEAPLAGAKAASAVGDSFRAGLTDRTAEGDGRKSDGDDQEIKSGSACARARSWRETIGVGGETESSDGSQETVEQDSREDEANSEERAAAREGFQGEAEITGRRASVDRNEAELAPPQLQRTRGRGDSDDVRFRLWWRSEKLERPSRGDGSEEIAQALPDSPGAASGSYGQDQLAGGRRGGAHLWREDVGFHGKRERFLETAKRSGEREVDCFSPEVPPRASGVHRVESQTNDADLEELKALSFELGDEGQAVGEATGEASGAEEPRCHALHGSATRRDGEAKGRLGLPSRAREAGTKPNVEAAFLSPRCGLGRSPRSVSQDERASALFQSCREEEAVSGPPAVPRPPERASPSRVCSSPAGFSPRITRAAAAGGAARRPEGRRSGRAEGDPADGEGRRVDSRHGDDRSGGWRVPSAGERSDRGATGSEGDRKEEQRGRDWERRRGRTLPIEQTTDEIDDILNTDFNNPEEAEEQRTSPPGPSSRVRTRASAWRRSPVSPQAEVLESSSSSGPSVGPLSASPGTAVDFSPCLSARPSVVASAAALFSSPSVSSAATDPNGAGLFCSAGDICAICTEELFQKDEIGTLAACAHQFCFTCISRWGGIRNYCPLCKQEFREILRHHFAVCPRWGSSPRGSEIPASASPRRIQLILDETVAVSRRVAGRPLGDDSEAAVADLLAEDQASRGASLPAPGGCQVCGRDTDWEQLLLCDGCEDGYHLYCLTPRFYAVPEGPWYCRQCCAVSTTAETSTLQTIARERTRLLSSASLSYFLNDDEGDARSRRRSQPGSRSSVSPSVPALFSSPNAVSSGPRQPLCAGDVPAGGDELGVSEGGEARVARGHPMFRGRRRGRGLTGRVRAVSRSPTGLSRSPSPAGSERTPAVSARLLHGGAPPFERFRTPTETLASYERRRGAQMAFRDQVIRLPPVTESASHVPPAGSGRGESDETGRSGDEHESSAFRRRPGRRRYLISVSSSDDESGGWRRCPPPLAQPASAGAVSAPTAVGGAVSAAAARQWLEGRARSRGARRPTRSDSEESDLEGFVVKDDEVVYSSGESVSEAETSCSDRSSLSDREEREESPRPRGQCLRHAKREQGSSRVRAAGQNSRRASGRPEEARRKRPEKWTSGEERMHGIRGQQLGDPSSVAGERSGGSRSAEPEEPRASQYFVATSRRRVRCEATDGEDGSVESRWYTKRRRPDRRRE

SEQ ID NO: 893 - protein, 1808 aa, Neospora caninum
MAGFQLLGLLFAVLCCGASAAARVVLHVGSHASALRQPAVHFDAPSSFTAPALGSALSMRENLHFAFGPRIPESAAAKADPHAFVARGQKHLWRSSHHALAESWLSSFSAPSSGPPSLQLASAFLRCLQHPRATSFLQVQKNAFPASGGSARRTTIPSQRDTLVTLSLFFRLSFCRNAPYSPLKFGSHVYAHPAFLVRSGALPFSPFSAFSILSRFQRSNTIGALRMRTENLRIACSHLHTRFPVWKADRHRTADCFPPFRDEGRGRIHGRNNCNLRRYAGVFGESEVNPTGAEGRRSCPGIAEVPQNDANDARAGYEQASGAVHPGSGGEGNGSAGSDSPYCSRVDHRHGYSEPVTGESGCGDKTGGDDESTPCGLESPGDADEGNVDAAFLLKKAEELPREEIEGLIQHLRENLPHLIEPVHAQFVEEIHRRLTSREDADETSSPGSAPRSAVSFSAGEESEEWRGTEDGMTKDTASSMEEGNDSQEDDAGHSEVAADGDEHYEQESPPEAQISDSLFDDLSIYSAEELHLILRLLLREAEKVDRAEASGTSVGRPAEPRLPPAPRRDLSTPPWETEEEDEEEDTGPSGASVPLAELLATRESIGDVTAIPRYKLIEILEKLSPFIAALPFDDFLNAPSAFTTEQLRDVVGLALARMQQGIYSARDPMVVRRIGKWRARREKYAAFRRKEIASEKQETGTTGEEGRCGVELSGVRTVETPAQIGNVSEVRKGGKSENVSEANRTRRHQSERGGETRSAFRGLDLSLPSGTLDPSKLSRLSDSMSRGVYGVKTLSPPPANAEGSHLDGGGNEQMTEGEEIDVADLEDEALVDDGTSEEGFSPHKDSESILGVADQAEVEGMTDEELTLAGADVCEMGVTTLRTILASDENALYRPRSLRTKADVEALSWRQLRDAYAELSRRAQGNEESDIVQGKKKIVGDEEGEAEQGRTPGGPGSGGEDTRGKDKKKAAKQRWKGAEEAETSEVSEAPDKSLEASTWTFDSRSETEWAESPDAERLRKGRDVAAAARGCLQYVAAHLKRAASRDDASRSIAHLDDSASEFQGETDVETSVGAQAVSKVGTEDEDEATDLSPVSSSTPVSSLRPMPSAAAVTAPAVSAPSFSSRESSDLEKKASVVLSEEETFSTSPVSTQLSLSSSLASVSSSPSFLSFRGLGLSPSVAASASAFLGSSATPSPVQAAGIPRLLRFMNSPEEAPRGALVLGAQTGSGKTLAYLLPLVHQLKREEERETESRERTSRGSRGQNRSSGAAPAGNDACRSPSACASFVPGRGEEFDEEALSDDALRHFDQKEAGRPRALILTPTWELADQVARTLKALSASFPLTARTDETCRGSSETAFAGRVTHAQQMMAPRLSVLSLAGDGSLGHQRQQLRERTRLDVVVGTPPRILKLAEWGLLRLSDLRFLVIDEADAMLLSEGFDSEIRQVLANLSPTGRRFSEAEADTRRLQESPERRGSGDGKESLPRADGRQKGAVPDDRRAKGICRIPVIAAAATVSSRLGRALESLTGGPAELIEASGIHVPPESVRHEMIDVGGRDKLELLREILRSHEGIRAARKVLIFTNSVQACRACDFAARDTLARTPGGSGSVLSCHGSMPPAIRKAHFNRFANGACKFLVCTDLASRGLDLPAVGAVILFDFPLSPVAYLHRAGRTGRMGRKGLVVSLVTKKDQVLATAIQRALETGTANLAELSSNKADYQKGGRLHFLSQAGGYNTTERKLSEPYRVSSKTRRAGWKPPNTWRLGASPQRVGDPPENMASVASGVGKYDRLKAPVDTPVPLISFRTVC

SEQ ID NO: 894 - protein, 1531 aa, Neospora caninum
MEDRRAASSRDRQQACAALESSSALGNGKPGVADGLRAAAARAVAASRRSKTGLVAAASHLSANAGSALLNPLKRRRVREQGGEDDFWSPSPDFQSPVTVEAHTSEMALPRRKGETAESRRPASRDSRAPAVCTAAVDGRCTYSPAEASAPENGGGEKKRKKRLSVTMHPGSPERLYYEAYDEGDREATEAHSGTATARTGTLLASAPVPGRGAAKAAGALSERLDRYQRPSSQKVESGGELEGFSSAKVKKASREATPSRRRTTSRGPGADPNEKENKALQERSPLPSLKNLYVQLSDDEESPAAGGRTLHTFPLSGHPPGKTEERGDGSEAPGKASQVPPCASARGQAPVFPSLLTHAVAGGSREDTVKNAERPPASSVSSAPSFSGEGRPLTAAEARAGESAQNTADTRSREINAATKQSEQGGADEPPEPPAVTLSVSSGLQCELTPPAGGQYGACGDPAAFAPFSASMAQEPAFTSPSLASASSFQSSFSPHALGADQLCPFSPSAPSPRAAPLSTLPLDSPWHAVPAPLRKAVAECMQAFGRERSRQLSRLVALLGDVVHPVSPIEVVGLPGTGKSHLLLSLFGASGLAWGYVDCAAACATAGAGRLAARQAICGKLLLHLALQLRRELGAALHSVHALGACARRRRESPRASEGPQEAQERSSARPQRTKSASPAGPTADLAAPVAPSPVSPRREPASASPFASAAALERLEAELQEKKSALDRLLRQMQSGGKRSADTLAFSGTLFSAGFSANSVEQFVSLLRQLLRCSSPLARPFSVPLVIDEAFCLAQNMPDLLHALLRLPELLGGESSLGGARSEGWGASPESPPCEAASPESETDPFAPEKTLEGKELVLPPRNVCVVLVGRSPLRPEIFEGLPQPPRVHFRAYEANESRDILVRSFRSLGLPVLRLTATQQAARRPKTDCETRQCTDTELSARKKIEQWVYGLLEPVEQRTVVGVAGREGEDGETSRAAERDAEAREQAKEAREGLREDGYAWESRLVLRRMRRRLRDPHAPEQLDPSTAIHAAETAGAGNGGEAPKDQTEKLRSATPMRRSCVEPSPGTELEEGSGEYEKTPYATRGGKDHARLSSRSEAAVAQTCEAAACGVTVSSPGENGEGRGAARAPEEVDLLLDVEVLWSHFVTLFIQAFHQSLKSDFHEQRFLCREFWGQAMNLLLQDPSDAGISALAAAATQAAATQAAATASSPFSFASVRAASVAAASFLARLLHPHFRAALRHPFSHFLPDLQNRQILDAKRTTVWGASVQDRHTAARRLELPRLGKVLLVAAALAAYTPASRDKRHFNDCFGNVFRVARPRHAPLLQSPLLATGRTARGSPAVSLSPRKSAGKSVSEKLEQDFLPRALPKTFTLLRWLALAECLGSAPAAKGRQASIGMMDAGTCQQIAALLRLGLVRIATGSGNDARGSGGYGALGVLKTAAQTWGSEWTQPLGWVLGQQQFLAVHARGKSDVFMLGAGTSGAAGGGYLPELFNSHARLALHAPLGVVKESADSLGINLAEALVG

SEQ ID NO: 895 - protein, 522 aa, Neospora caninum
MDDEEALVEAGVLSASAPVLTIIYHRTHHPVSSRRRLSPSFPSSSVSQLFARPAPVPSAHQNGPSLIEDRPSGVSSLLSSLSSSAFSLFFSLFPAEEEVFLSPEVVFLRIYCLLTNLRVAFLPSRYPSTQALGNLPAAFYNDGVLNGRSLQLLLQEERDLDALVAPASPSRLRADSEALSAYIDAKLAQVLDFTLWCYEPCYSRFTSRVYRRSLSSVYAPFFLFRRRRSVAARFRAVDAVHILRTFLEVLERLAVDERTSKKDVSPSRGAGRFLLADAPTKADVNLYAYLSVLFQIPSEYTPWFGARALTASPRGEDAAEAGNPPGPRARGGAILPSETEDEGGNASTSSSSPVDATSWVSAPGSLGGAGIEEKERPTPLGSHASLTAPVASRLLRTLQQEQDILSRLAALLPVARSYLRMFDEFLAETAVAALDLSSISAVERRKEGLDSVTGDEARSSVSLFSLPPKKICVSLDESVKEGDGAKRSASESEEKEARSWTKTSALVAAVATLGLLAVCLKR

SEQ ID NO: 896 - protein, 2379 aa, Neospora caninum
MGIIAVYIEPESIAPTVDGEVRITIEAARFLRKNYLYRVRAVTSKLASSFTDGRWSPTLSQSADPLSSHLEVPPDGEVVITFNSAVDIGNLNDERLHARLIAVAHYRPGGGTKEDEYYYVDYDARKCLDAEVDSLVSKGPDVSPFTAGDQDRQRDEVVGCAVLSFTRDQLRSGQEYELLIKKKIRYNKMSGPTGQRKPVESPSPHVTADRTEYLQAATLASSSTSVFSRFLLSVGEVPNDEDPDSQESTEENLEEEDSDGDDRYHGPDGGEDGGADQAVSSNRPESSGFVYSETTLNLRQFEKLGGGSVGLQLTGLRPFKFFGTGNSSFRSMPTVRYRRLTLLLPHGLNGCQPKKHLWPRTCWSSWTSVDARSAKAVERLAGQIDLRVEGSNQTVNFTLHLRDSITAVLTSRDLRPGVNYVLSVGGSVMVRDKFNQPLQPSVLAFRMDRLQNSARLVLPRDPRVWLIEDSYLRHQLQERATVHLGTAVQFTGSGRSTGVSSSNEDMEVRQVISNDFGECLRSRPEACLATLFDNFTTARENYHGRSVKEVTPSQTFPHPNLVYSFKNGASSMSGSFKAATPQPFLFHGFTTTSLFLITVKSKDPVQLYTSTSHFLWGVSRFLVRVAPTVRHEAEKAPALLVQALDLETAYPLTRSMISVYGKPRGGSVVLLGDGMTDVRGFALVPVENPAATMKLILVVVPAGQVAPYVSEIFDVPSVWFAPNTAGSAARPSWDVPRSRLRLRNGEIIYRKDLSFVLLSDRSTYRPGESILLSGFQFLRVESWDSGSRATTLIHDAFGLDPGDLKIWLQVTWQTPEGRGGTPNGVPPRGSSRDNPIEERASADRVMRDSRGAVSSTNRGSAGDAEECSNVVVTLDEFGSFVATVNVPTKAEHGLRAVIDVGIFERGGLPEENAIMAGACMLHPESLVQTENIVQPTVLSRPNIVIFAPRRTAVFLTEVNVPPFVRHDGQLLVKGVVKTHDGLHLNGQQVRLRFIFDVPAFLLTRFGRNSEDCLVVSFALPYLEPLPLMQLDLSENGLYPSTAVAQNPLALKYGPFVVQQEIKVVVSHPVRELHVPAGAVDLRIIDSRGLPRKTFDGKERVTVQVTVHKSRLGLDGLLKVRGWQRNVTSSSDQRDGTSVQSARPISASSFSTPTSASAFLTFPSVPSNTSVNPSDSEETGDGSMFLDDLPLSVKGQVLLTMVDKRFLDSASAPVFPLADQLDKRAAAGPHHGVGTTVLKWSSSLDQVCSYEGFRFINEVKQRRLATDPWFDDLPWPLLPRMFYNSTYSNEYLDDTAVYEKYAWPLTGQFPPKHASSLKKVRVSQRGLFMAEWGQVLRPDPAEAAGNDGVWDVTPKASGEPPNGEEQEDLDILEDVRPFHGEDHDADYELQFLPRTQPIIGWRAVELVDIGRGILRGSLEVTLPNEATAHAVRAYTVIRVSPAQTSSSTETIPGRVSDESPSETHSAFAATDTSRRGILVQDQQSFEAETMARERYSGTALMVDSLEKVFQIRKSVAVRAYAPSTIRREDVALVGVTLDAGPNLIGKGAIVKLVSTSLLTPLTSLTPRTQRVYIERPTQQVLFHVAADRGFGTAEAIFSVGLGASTSRLSSQRESLSDWFTFPSLPSMGTTFEASMARSSLNDNGAWSKRRFRRVVTVKVTMEVLPSLRRMTTANLYPVEALNISLDDPAVEALGYNTRIGLPLPRPVVPDIGTLRLAAGISGVSAILFRLRELIQTRLFVPYENRSMDWFQRPYNGSDLLIILFGEALMRKAYGFQDAQVAVAADRARTLLPGFYSGDSSRGFLAAPAKTVKGANAPLSVMLTMLAVFVADAGVTSSLKFQRRKFVVAANRYIRMMASTWNQNNEGMTLLQYIGPALIGTLRFVLGSSHRFGLDLQSEHALSTTSLLPQTQTTREDICDKLPPHILWALLVMKRENPTAETHPVESSCIRAMIRLFRRRGLKGYIALGVDTDEPNTNTVHSLMLLLLTSRPQWTQEYAEEIRAMMIYLYGGGRKPPRAFMVPGLSRWSLVLLLLAIEQWDRQLRNVTDQNLVLEVQARESSEIDGYPLIDGRFYSHHRGPVERSIGWRELEKKVASRRNEKLRRLFADEVPVAKAGLAVLAVGKGTAIVSTLSDFMPSRPVVQPTYEGCLVQKRYHLLDAHRGYCKPDSTLVVNSGDRVCVFITVTFKSTAKLITVRDWLPAGLQPLDEVAEGFSPQSLTPIPRDQAADCAVTTPFLEGHCKKYIRGQAIEWVCESLPPGTHSFAVLASANFPGFYEVSLSTAFVYVLARRSVPGDQAGSTSFSRTLQGTSGAAHKAFAVLPINHGTEDVLTMKQIDPFTIAGLPTPPLWFLEGRPKICPTCELGTVCSPALGECVSEGF

SEQ ID NO: 897 - protein, 2636 aa, Neospora caninum
MASAQADEGTGGSLRFFKSGASAVSTASRLLSTETTASDFSRSRRPTSRLPTDPFVSPENGEAPEALSLGSPSFSKTRPLSTERASTMRAVAPSLSRSNSQTASLRTRSIYEEERFSSFQFSKTADDSGAGYSGFLHRMPFASAEGNAGSTAGRAGTPSFPRLDAEKDTLSDANNSPSSLARSVASGSHSKGGAAVLASSLLQRSRNERLTGMRACAESRSYGSEAAVAGEKSSRFLTSLYEPEREGARARQSGDRFEGGTRLESFALSTRRRGSDLVSTGRLHESKAQASSVPTFLRTSHEATSPVSGRGVYTEQSRRLEEREQDFGRDKPSFLSASSSPRQQPDPLRSSSQSSSQNGVVLLSSRNLHVPAERGSFRSERLVYTSYGGGKGAVSHRESEENVKAAPSASRHSGLSDGRLDLGDSSERSLHRRGPARDSSGARVGDTHLTNRAFLVNGDSPKSAAADPHARLGDAAPERSSFPRGSLYESRREGEGLSTSQFAERGRSGDLVGEDGTRGEPVERRWGSSLGLSGARSTGRDGETLHAVTRRHHGTEREADGGDTLFSPLGSGRDQSLVSPRRGDKPTHFSDFGLGASRRERESAAGVSSPLASRPELLATSRPPFLPPASFATSDGSTDRALAASVRPKFLGDSGHKSELLASSRDGESPSGRGAARGSTERGLSLLQSSAVSRRSGFLPATPADETDREREERLPAAGPKTAGLEGDTQSGECESTKGSGFRSARVGATEMPGGGRVSDGSRVRSNSALLRLSQGLHPPLPRVQRVGEEVFQREEDGVERCGVRQKRDREVLFSRSSSTLRATVPTRPVLRSLSQPAPGAGSAVSPSSCRAKDIPSDVAKASFQKEGGDRNDLFQLYEKNKSTTPGSASSASSLGDGARQDTFLDSREEAEEKNRESKDARLLGLAESGVDSGATSLARFAMATGGAESLGGASARAPHLSTHQPSSLAAEEGGSGARSPRASLEHEQTGGLSQRSSRNSQLSARIENAGFAKPSAGGAYPGLLFSGTSAVTGKPDAGGKGSTVCVCQASRYMSRQKAHYEQQLRRVEEERDQQQQRRRLLAEQEAQVALLQSQVQRQREGVMEEEKHLREMRAQVTAEREAMEARWQQFEKQRQELLEKKEKWRKTAQQKRDELQAFSLRIRADKKELDEKKKEVARDTTSLKDKIESREQDSLNRQRVELEELRFSLDREKAELGARISATEDERRRLKKKEEELARREAKAQSKEEELRREEMEVERRTQAVALKAEEEEQKELDRVSLWRQKNEELDRRARLLHEQETEMDARAHALRRQETERKREDEREKKKLQQLQDAFLEEKKNFAREKGRVEAQLDEEKKRLAEEKKALEHDRKNFEAYVEEERAKWGEERRAANAEFDKKKKEWEEERSSGEAELVAAQERIHKTEKELEEEEKRRSEETKKLTQELLDEKERIARQLADQEQMRAMLSAEREKLQEERARSGEALQRERERLEEENGRETQRLEAQRERLKEKEAEIDAEKERWQAEREAVESRLREEEEKVEQGRRLLSQQREAFEEDVRKEREQFRAEQEAVLADFRSQCQAAERELGEQKAQQEEMIEEERQRLLQSEERQQEAYAEQINQLRSLEEEVHQQKLHHQQDVSRHLEREEALFERERRVREDEQSVQDEKQKLSKEKQGVARQRRQLEEAQTHQKQVEAALKKEREEIEKKVESLRDQVLRVAEVDEKFARLREAEDALEIERAAFEAEKESFKREKELIDAQVGAWRRKLSQREQEVGRREREASTRLRDLETQEKVHKVRMEEEGLANKSVKQASGSVNTRRGVSVSGAATGRAPSVSRPLSRGNERNGEATEQREGELGKDREGKKATSNSRTRSLSTERRTRGVGAGLAGGPKPAAGRRTLTPVDQASRGLSKWGRNGAGREGEAGKEGEAKRANGEAGRTGKRPGAAVCAESVDECEGEDTGAFTRERATSAASLQDKPGKDGKDLSGKRDGVSRLLPALRGGQKSFAPPGSSTRASSVGRDGGEEQDKETDRRPTRGIGASARKPPVHALLSSADRSDGLPQKNLPFPLASPAGASPSRKGLTEGQTVASSGRVEEGEDAREEKGGNAKKMGMSRRAGFFPLLLLFFSAAIFARETFPRVSHLAASRQSCSTSALSHPFPSSSPVRDSPDKTPGHSSSSVYSPYTFRFSSFLKQQASSMGEGEDDDAKRTNPSSETQCPGVSSFSSEEKSSAPSAGRQFSSLGPSLPPVTASRTEREEGKQARVSPSVSSRSSFCVSPLSLNGLSTGTFDRSRVERSQEAPQGDGEASSPRRGTAVGTAGHEETQRNVLMDREERTASSSFFSSCSLAHPVSSRISASATLREERSRSSVERSREDEERRRDEEHREVSVAGGSSASLSTQTRAKETVYRREGTGGPAKRGRGDRDDSGSFLSGKGDGFSGRETLSRTPVMSPSGVLGKERSVLSRTGSTEQETEERGNSQPLRHELQSPRSRQAWKDRLAAACAPRRSIPLTEAEDDKEARSPFLDSLRSETNRNRKEGESPFSSTSVYRRREDDEGKIRGTMFRKSGEAGSSGSFNARESVISHLSAFNPAEDNSDYGSGENSLSGLGSSSRISTGRGKTSRAGR

SEQ ID NO: 898 - protein, 4004 aa, Neospora caninum
MEDPGGAPAGRYSAVSGDVEKASLRSPTGVLGEEQNNGFSLRGGVPDLQVSPPVLPSLPSSGPPSLLGRSTAMDAEEAHRSGDEASFAYASASHRPESPASPVEDDDRDTPCSPPQQTTSPQTSFSPLVSEVAGDALPPAASLRQTPGTLTRGMSSRSSSAGWRASPGPVPSSTPPSPASSRSGSSPGGRVSSPVSSAPLGPAASQPAAPGRPAEASRPRSRGDSHTSGAFDKSGESFHGAGRGGSACLERGAYDREGDPAGSLLAHSPFFSPLQSAGGSASAGATGSNRPQHPLVHASTPSWVKYGEEHYPEEAVPIEYQWIEDDGTCCCYVTDFLLYNKKGERLLQVETLDQDELADVALYGKLVHVALVHPPEALEARKHPTACQVYPHLLQQRRRQNSLRGRKHQATEDESVSQQVSPRAAASVLPKEGDKDKQGREGDSGAWRSEGDSATSYSSQREDGDKKEEKLLGDGEKEVGGSGAATPSLGTGRKVLRKRGGMLHHPCITPKIPRPFRTFPVRVDLTEWMIDYGKSASQTPYVWLVSSLNRYYRLEKPAGRYAPVLQSLKYKFEVASRVIKQLSVNRLYPYQELVDHLTADSRLKQALAKKPAGKGEDESQRRSLTGGSGELDKGEAGADRSDAGAPGPGGEGDRSGDGALSPQRQWTREETAGEADKAGDDAEEDEKEEGDFALGKGAGLQDSPRKSGVAGSENEGLASRDPERLKDGDLSGPSSVAGDEDDDRPAGDLASGLATSPSSKLSGHGAHASAASSLLGSDFGNLILPPGLGSSSSLPLDPSSLFTSSKFISALAIKKNKNCHLLSLSDPDGTGVRTLPDGSLSPESPWGAALAVEGCTEESLIEVFPFLESQVAAFEASTGTTGLLASPFMNALRARVFRWVGKLDDDNAVEEVPPLQQTTTPEIVGGRTDEGGLLSHQSEEVLVSLNAFASSCAADRPSLSGAAFARGGPGDRGQAGSGFLDSPAFGDASGFFGSTGPRGGRRGRTRGRARGDRGEGGRGRGRRYAGRDAAFSRFLGDDREGDFFAGDEEGRGRMDPEKERLLKRDGDTQEEDDEALTNKTCDGGMDDGPGLSEDEEGRKRIKREEDGTDQAGPWPKGDEGQRKEEEEEEDELSTLPEWGIEGDPVDVKDELDLEAEDPLYARVPLPGGSFAPYDFPELLELQDFCRVFLEMLQLPSYPVDTLEAALLQSASWSVAQDFSARAAWPPQLKGQGVQGMKSARKKRNPNIPENPLPFIAASTCLAPAPEAFQFLSPFAAKHEDESASVSRQTTEAIRTGAALRDAAAVALADAAKAEERSSGADSAHLGERDAGEKVGTEHARQVETKREEGSGDPGGEEDAGGREQGVNGHPQRDGDTNREGTGNRPGEHNQTSAPGGDDSVASALASSPASLRPPEGPSVFSAASVNPARLLLSTVSPQVPASVSPSSGPCAVSGSTRLHSSAFPVFLSDALFLRLLQLAFLHISDALSRHNKSASSSTGESVNPAPDARPAQLPCVLTAAGSASAAGLGGPSPAAGASTGLGAPGSAETPAAATWLGSARGGNAGAPQGPFGVGAHKGEGASAFFGRWTEQVDDGEEGSGRGGTLHGGGEGHLALGGSSLWAPSGRDSGGMSLDAKGDRTATKAVVGVAMKHFWRHAALGPRLRRLVPRHAEEDEEERDESQKEADEEHEERESGGKAKKGGLRRKELGGEGETAEGEAEDATTEEESQGRETGRDGKRGPRQISPGAASHKDTNEGDRAPKVLHMLSTAPLDLRMMDFLTWPLVLQRMLFDCLYTPRRVAVKKPRRRPASRSEEEARDTSDKNSGQAAQDEKPLEGAMKECDDEDESLTEAKREEKDEEEAGTPQTPHTQEREKGMDPNDVSVASAEEAEKLVAEAGEESGGKCEPAASCLASSPRECDFQTAKGEDGEKEPVQEEDGDAPASAPAPGDPPRGSGRRDGDSNGEDGEGEEKIAGRIAAEGEQGEREDAADSAKEAKRRQGDAGAETAGGEEAENKEAEMAVRDEAEPREENGVRSDEEDANAEEQGDENGVDSFQDEDATKPPLRATTRSRDTKRKREVDEDDGEGGKEKDASQTGEQDDGASPADGAELKSAGARKKTRRASNDAMLGDDEGESASKAGNGEEDDDEEEAEEEVERLEWHLDDQKAAQCGILPSRAEAMAITFHDMRTHSEADVTRRLQLLQWLIACIANGWMGKFFLDAKVEALFRARANTLRLRMASMGAALTGACRPQAGAGATGGAKVEGADGDSGLAPCSSTEAPAPPLSTNADDSAAVDGERPEDPNLPASSEAGDAGVSSQSLPSSDSAAPVCGESTSPSEPAGPASVRGRRAGDSEEKKSGRASSADGESALPGGKRKRGGASQAGAVGGKGEEEDCASVSEAAGKTPSGNAEAFEAEDDMGRSVADGACTAASAQGPGGENALNPSARGVGRGKKPMGRVSNWEMELLAQKFPIRGEILGEDRYLNRYFLVPTARGVPRVFVEAFEQTRIDPAEALEGFLDHVTSAAVEEEERRKEKEGNASGPTAGLSPGMPHAMGPRGGGFDASLPGTAAPQAPVGGALAGLGEGANPAACAQAGVSGDRGGEVGRRSSRRIALMKEEQRHQQELQDSLSAVSVAVNGAGRPDDRKRKRGSLSSEGKRAGLLGPSGSAGLKPGDLAGALVGPAAVLAKDGSVVSEKAKLHSPRDGEARTKHLNDFVRRAVGFESISTYLHYLDETLKACGLFVVPPGRPLQQLQHALSPYLLRERALKEKLRRVDQQFQQLAAASPLPTPVPTFVPPSPFAAAIWHGCRLFLQIEEALLLPLFSSSWGFASEFQKQQHILRLLDQTRDQCSTSGAASRSRGESKRGAPGNEDDSGSASCGPDDEKESGQQKPESKEKEDQNLAQTDRDLLHQLRSRVWPQDVLHRCLSALAAHANIVGGVQKGQTTGGVVKKLEDAKSEKSIKVEADASKLLATDGEADADAGHPSHVEDQEAKDRAREERQEEEQEAQWMERRICLGVFVQLLLYIENRLHTLSNVHTAAWHLQQHEQWRREVTALGGASLLTHLALPLPPFEFAASASGGDTEKGAGEKAKARDAKKGREARDEEAPVSPSGSRRRSLSEDDGAAETVPWREKKGQDRSGKGEGSGEADGDDEAEERDGEKPNLDWQSRDGDDEDRRGEREEADVPGPDSHEGPESPRSTCSKAEAPALPSPRLSAAAEREPPSPVSVPAASAASALSPTSPLRRIHALIEAIGWERDRVFGFLRDLRTREFDEMKRMQELEGLAPQKALFERELFEGATLQSTAASSSFLPDAQEDPVLSWTEIRNRHDVLAIWGCYLNLWKAHGLDKQKAIDARTTVDRNTFLSLLAHEEQKAHLPEVGSRLFYFRKGHEQMMKAMQEECVDASDRKRWLDSTSIPLSIPFELGRVEELVVDSISYHPGIISPLPRPPAAATSAALSLLSGPAGPEAETACLFPEKMYAFSIVDDPYALGLLVGDAARQRVRNAPSQTGAAKREAPGPSAGAAPTATPGVSAFSGSAAPTTTDLLLSSRLSNSEGPNETDFLAVPASNSAAASTPGRASSTVRSPGLEPNFGAVDRGELDESVTPSDPFLSREKTLPAGVIGKSELELLCAADPIVAAAQEAARGKHLLLQEGKGRDEGDAAEVETKAPVETAPYYRMVCRVLKRTHDTTADNITDRVKSIVAAAAAANEEKPHTRTSSRLMSYQNRSLSSRSGSRSSSSCSERRAGFGRHKGQGGSGDDGAGSQGGAEGAFQSPHASGPQGEREVVLCVPMRADDVEFVVRREKVFHALNLNWIPGMKFRMVFHTTVPASSSDASAGKEKDGTTSGSGKDSAATGWVGAVAGGATNAASAAGGGAGGQGASGAGAGLSEKGSACAAGDRPAFVSTTTRYTGTIRRVDLLHPDFWENVVVEWEDRSRAGLGALAGSGSSRSAGSGTDRGTERGGAQKHDADSGFENVSLWELEPLKRLKRPGGSAGD

SEQ ID NO: 899 - protein, 2083 aa, Neospora caninum
MDGGPGGLPPAGGYPPGFLGYGPPLPGTPEAMLHVHQQAAYWHAFSPLLTNPASGMPPYGAGSSALPLPFASAGAAFPYTAASVGMHAENKPEDAAFQTTGQASTAYACAASSASHAPAVSVEGSAAPSAISPAAPFSDNCLAEGSASQQSSAAAALPTASGTASCSSFLASSVRASSPTRHTTPATPSSLSVSPSLSSSAENPPIRTAAASGAAALSSPPSPSRRDVASKERASVKLPLASLPSLSLSDAQRTPAAGVSSFPQSPAEAPCDRPDAAPRSARAVECETAPSFAASPEPQDGTPHVGKSPGEKAKGPGGLRRVRVPQLRFRKKAANDVAFLKTFSKVFGKRGEPLVWCKRRGRPWWPGLLANPDDPHLVPPLPDHVRAKQPPIGKDGEIRLLFLCCGTWRYWWSSSKCLRDFREAYAAIAPRVRSLGFLPRLAVQHALEECDWRDNADWCPSKTLAETQTADEAGDEEEGWLTENACSSDSDEEDGVMDDSEWWSGRKIEPAERPGAKPCTTEAACSGLGGSRAEAATPQTAEGRERGPPSTEGHRGGDRAASPFFPLASASSPTGTALPAAPVQPAASVEAGLWSEGAGNRPAGREEEKRDRSRETVGREEPPLERDRKRARERETGPAPAPDAAVSAADRPCRSIRLGAARGLAPAPSGTARGGSQQASSSPVQAERALSSSGQVPSDVTSGSCSAPNGTGGPRAESRAGLLSTRSARALHPPFVSEEEVDSEKDVAPMHVDSEPLNPPREAAARELGDSRDASESLLGTSCSSTDPAPPARAPAPISSETPCSLPPSTSGSPFSMSLSGRRKGGSQKCCLAADAPTTSGPAAGFAASSAVAGSGGSPEGESLEAAPRPAGGASCAAAASAETGVESAPHVPLSWPDTIWHRLRRQAETARRKKGSDLPGPSGVSRPSVVPGPSVVPGPSGVSGSSVVPGPSGVSGSSGVCAPSGKTSLFLQSAQEAGTPLIPTYGAATGAFAPEKRAAASGAQPPHIRAAAAAGAAAAAMAAASAASAAAEKSQRREAARRLQASQASPRAGPAAGTGTGGGSGPETGSPDALTKAAPTAAAQVTGVWEQSERKGGEEAGGERMGRRGSERSAVGRSSGGSEGEEVARRRRRETRRGASTSRDNERSPRKGDSWRGGARGSKRSPSGSSTLPRQRLSRRRRLESRQEARSRREAKSHRRGSSRSRSSFSRHSDSRTSSSLSSSPSQFRRKSRRARDLSRARRLSRSASTDSREERRRRRGEHVGRRPFDSSWFEDRGPGRGGHLERWGSRGSDWKRAGRERREGSRAGSRDEMGSFSRSSSSGVSRKPRDSSVGKGGDWRRDEVERGRDCLWRGGRVGRHAWGSDSKSTPGSSCSSSLSAHSRGDSPAVGRRGHDSTHPSGRHGGPSVCGVRGREQGGRKRRADVSCERRSDGRERGASSERSPDSLSPSPGRQTRRDTKSGKETGAKACPHPEKGSPQPAPESLSASVPAVSSASTPLLEEGGGSSLQRRVAESPSRGAPNASSPVSGLPAALPASEETFPPTHAGPCGAASFSLCSTFRLCDGPAGSSPAALGSAPPQSGSASEPKASPEAGREPEEPTGPEPAERRHEGDGADADAPSPSRASAPINALAPPPSHLFASSAASPPPPLAARSGSYQRGEASESRAGKTPWLSPSEPADARGRRGRDTRGRRSGSRSPSSLSSSRSPSSRASSRERRKRKRRAHSRRRPTRRRGPRRSPSGSQTERSLRDCDETDETSRSSSEVRARGRDKARHRRRNSPRRGRRVSSEDLSGGSTQSPLHRRGLSDSQYLSFAARRVRVLHAQGRCLPCRFHWRRQGCRNGDGCKFCHDPSHDDLMLCRDAERGASSRSRSLGEREHGDAGENLRPGADDGVRGRGMRLFRRSFSGSRFAGRGERARGFDAGRLGSREKRPRRIGDSLERDRERCPAGSRTDGRERWTEGEGSQQSNLDEGDRREGATNSQTEERNAAATETLEACNGTAEALEGERGKGREMDNEHHPAATVPVDAFDIRLPRTHGENGEGEHSRACEGVIPDGQADVDSLVAGASDAAVSGGEVPG

SEQ ID NO: 900 - protein, 2277 aa, Neospora caninum
MALACRKASGARQQCVVLGIAGLFLTLFTNAGAATVGSQTADSADPTVRTCNEGEETVINLSLHENTARFKCGSTVEDLSPSLREPLEGLDAFVDDAGTTQAQFPFPDVAIAEQTKVYTVSARAFPAVGGTWYLFCVAKGTVGAAANATKKCRVQLVIQGTSVIRQQCTTVGGSVDLRILGSGYAVTFGCGLNFPQLDPPLSGKEVYVGRDCSEKQPLTAVVPSAEFDAAPTGQLFTLLVNKLPPSERVLCYKCVNDSTDPCTAVITIPSPSEAVTTPVATSDAIVSVSSDNPGGKAWSTRRGGPAKRSGPAYVPLPSDEELRHAFLTQLLHEPQNDAWRCCTCCSTASEGEPPSSHFPSSPTLSNAAHTFPGRPETPAFPVDGDSRTVGACALHPEEGSGDGVFESSPSFYYDLYQERHFEELTWPCGPTAMLVLPAKSSSACPFLDGGRAPSHRLSSKTSFRFPSRPDAPCRLRQSHEFSGAERGEGGLYGAPPAVDRRDGPLRKCPFSSLGDAPRGVCSLAYPSPHCRDLALSSCPSPGSCPAPPPPKADPCLPVNSAFFSILWPVVFVRKEIPAFTTETDASSLSGSGKQGGAEIAAAFAAHAGRHTSAFTGGTPVPAALLRPTSGRGPELTTPGSSGKARKAEDPEDTSSAGFMGGTRKGLGGRVIVALAALAIDDALSVDSLHPATASSFDLPQVTAAFHVLDHLTDLYLSLSLAFPPSTLVSDPATVTSPTASVSSRRPAASPAPSSLLPYAGATMSAALPHSAPGVSARRPRPQSPFGSPARGDSSSEGASGVQSRPTALPFLMAVLLALPFGRPKLTSPSLLQNAYESVASLPVSYSFLPPQTGRETKRRGTGARGRSRESLEGGAAEPGSRSASEEAPASGRRRHRSASKRRKVDGHEEDRAYLVPPRPPGPNGPSQSLAQLREAKVKQYLESLSPAFSTVDLSQLPAVSADLRELQLRHWRRQLEEKRASLSSSDSPGSGPFSDFVEAALGSSVYLDFEDQDGAAFSDVSFSDLCPPVAAPHCRTLHRRFFEHALWRRRSSSTSAPLPWGSPWAGSDPVGAQLASVSSATACTSAFTPSAAGSIWSVPAWLPQLSPSGWAHGVPGDSREGEEGGENLKDVSKAGTAAASTSSSKASRWWMLGTKKKHRSQTPEYVGAGASRRGGNAHQSLSTDGRSRREKGRQSWWKKSRDASVARGEAGRHARGSSWDEERCGGSEWHDSGAATDVEGRFDAGRRVGRSRERHRLYREGSAGSLVLLNEALGERALPRVRGTRDLPSSPSPQKGVPGFSIFSAFGRAAGLMSAANPDSQGCSSRWKWLTRSSWIRFSIVENIHCTMHEPRPGVQGPEARASDECFIVGDLYVTVCLRKMMEVSAPLAFSRTESLPDVYVHPTARLSNSAVDLLSCASSKSVPSRGSGQAEKSAGKSNAPPFSAGSIEGREAHSVHEGRGALPPLVISCVPPLGVQSYLLCKYRFGSLPFYPMKALYQVKEVRPGVLRLLLQVQIHPGVVGRLHACSLWIPFGHKGTIESHDLKASQGTFRIVSDQRAVLWTLPKHLKRTPVAAAHASTKDSTDTSSGGKEEAKASPTSGRPHVSLLGELVLAPLSSSADSEGHDDFTLSRAPSNPDRFPMSPRRRRARRFLPSDRQQSPGESLQPGPCGDGSGPSGLGIQTAGRAAKETDPAALLAASRASAVAASGASTRPRLLPVPDQSPQARAARYRQNLIAAAGAEESLPLAVRRFLADEVERAEAVARRFAGDEGQLVGPGAVRDAGSGAGRARDGKNGMYGLPGSEEERVPEHNLSLGSQREENLRAAHEASLRTGQPHGVGGGRAGSEEATPSPFPDRVEGGGSSAQLRIRADGGGCRAGARADEDGAHTRGLAPSAFDSRGPYRPQMKSPGPTGLPAGDGAARASAGARRGSEFGQGTYSGASRPGGSRDREAPPRSAVGGGGRGRQHAPPQTGGAASGVYTSPRAVRSGGGLLTDREELILKEGVNNFLALIHFEAKDMTLSGSSIDKEAVTLYPYEHLELAPAHGSSEDAGTRASSVRRGGASGAGTARGGSRGRRGDREKLQTPGWGVGSSGGNGDDAGCSISVFKRTVAGRYVVWNALGDNKASRVNLSFDEGGAEEAEANAYGSDFPSHPARPPNVPGGYSFAARAVPAFPSTATARQFASPAQDGSAGRGETEGGTTASSSVVFPDAARVRVDRSLSPGEPPARILGAAAAERGFAVETDSPSPQSRAGLGGFSAPSPSHVGDKIETNAEF

SEQ ID NO: 901 - protein, 2814 aa, Neospora caninum
MSGTGGTGSGPLGAGAGGVRGGSKSSAPRPVKIAAVSLIDLKEQAGKAPTPSRGWGVVPQPATSVEGSGVSSSLFPPVSALKQQFHPSQSGQANTTGGRASLSSLARTVRGVPTSKEKSEGKTKGDGEKEGTQTAGLGQRDVAGEESEQNEDAAAKGRGSSGAESGDSTTLEKPAEPQQSGGSVPNGPGAGGSSSGEKSGEGETETSQKGDSEKAKGDEARQDTPQSSGAARSGREEDGIAAPGAAISLSKLITASKKVGISVSVRGRAVNTAAGTVKSSGSAWKSGVSAAASSSGASASTPFFAGAASSAGPSSLYAARAAGAAPPTGPVDDEAFPDLMKSAEQVKLEAQKEKDRQKRTKEALRRAEKGDENGTSAQPQARRLGLQELFDLTEGGALSGLADKSGDKETGAARPIRVQRRWADEEPEEEEDFLQSGEGDKGPFYPEFGDGRRDPVFGKAHFSPLPHFVLPGMEGTVVAGYLSFMSLGQRVPPPAPPPMEPPAPPHAPVGPAGSHFRTNAFYNLPGAGAFGESGPQPSLLQEKNWRRQSPAPDGSAGSLLPTNAFQGGAPGRIHLLQRGAGNSEGQHRTLPPPGAVGQSPGQRMGPGVEGAPQRGPFVVTDADLERQRELARQKAEEKKREEEERERAQKERANKKLQELDERLARTRENQGVEQGGASPSGGGQKGPESDLAGSPALGRLVKGQGASLQGRGGARGPGTGPRGTSGVGDEREDEDWRRPSPPGVSPPSGPVSGRKSPRGAGAAGVESPFPPAVPRNPPPPPPLAAPARGRHEGVQKSLLGAGKNLHHHQGSGDPSGPLLGANPLIGGADLHAGHMKKGGMKGEPGENDGMFQAGLLGAKSHQPPPPPPATAALGGRGPTGKGLAGVGAALGERDGLRLHGRQGVQGPVGLDAGLGSRVVNGDEALPPLLAERGARGGAQFGVPLLQGRQGARDEDARPGFQGRKPAAGASERAGPDSELEGADFERRQAVGAARPRYRFGALVNQHLEERQKEEEEVRRGSHGADPAGGQGAASQREKSVRGERGSASQQSGGAVTADHSRSQSVRRRGEAGAGPDSGTWRQAPRQVNGVAGGQGATPSATEPALGPEGDGDAARQPGRDRGLQGDGPGQRGRGTKRDAPGVASQPLLPDGSPASGASSGPQKHLPRGMLPFPSPLRGGPQTNGSAGGGASPATEKVEGHGPFAARERGGRGAKQATSPSRENWRAEKAPVAAGGVSEDGARPASSGGRSGRDDDRAAGLVSGVRNPGQQYVHGSYARPANPQPEPAAFLQGAERGASQGGSQQPPLIANAPLLSFAPSAPGGLEAGRDLAAKGYAAGAAASAQGGVGSSASRGAGETKLGGSSQAVAPSGALPESAAAAGPHASSAQPLAASGGSGDLSFKALLSTRPAPTVLVATHHSTKSEDGPAPAFNAGGVAGSEGPGHSGAAEGALHSTAGDKTRGPGSAGVLGDTPYQGDDGDRAVRGPGRAFLEGDERGKDRARKGERGSAFLGGRGGSGSGGDSAGAVSQPAGRAGAGAQHAEAGAEGAAASGAGHAPAHRGQADRQAHAKPEDGERGGAARNLGTYRKAGGGADGPHRAWGVEKPGKALTSKERDEEENRASATEAERTGASGGRRNQPPFGEGEQEDSGAGVGRSAGTGPHSRTQRGGDSRQGEEPAHAGEGGNAMSGGRGGRGGAASSGGRDGTRRSAGGRGATEAVRSQGAGVSAETGRAPSPGGAAGDQNAGNAGYPKGRDQGLLASRGGKGGRGGMRGGAASGRGSVYGGGEKAETGAGLGASNTQTELPAPEDGSHRHRGQGGGPRGAASRQAAPGGAGTERGEREPGAPSGVVGSRGPATAAAASGRDRAGGTSGAVWLPKGAKKVRDDTGSAPGTTEGGAGAKRGEGSAQPAGGRGTLDARQGRVSPASGASSGAGGEGHGDAAPHSHPKASGRRDSRNSGGAAPPAMVEALLTRVNGALSVGAGLVCVRQEDHQEDTSAADDEGFQLVKSKRREQQEKRKKTEHKQRGSDRGAAVKAAPPSSNAGAVGAARSNARREKGQPGAVSSGVAGSGGDAQVSASGTKEAISVAGSTAPKGEGLGPGASPRDQGAAGVEGTEQEVASGGRGPRHEGGGRRPSASPRGGGRGGAQHQRGEGRKDVGKGGVRSEGGLTASSTMDIPTVSSDVAPALEDQYRSRQRGQEEAKADEGDTSEKKEAVSASGLLPLPGVGSRGGSRAPQRGKHAQESGDQAYGAGEGKGGGSGFSVGGPGGGSARDDGGHRVNEKGRERRGSTGKATDRRVGGHIEDPKRRQDSPVELEGQGPQGSHTAPSSLADPWYSASQGLDAANAMSQRLSSDPAQAALSDPQGAGLMIPAGHQGNSGNPGDRDRAGASPSAGPAPAAPAYSLWSSNFNQPVTSSSRVAPETIAAIWARDAGSAGATAVGGAARGARIPGGPGGAPDMAGLAHHPMTPVGMPLSPHQGAPGAPFHAGGQPGPLGPLHFQCPPIHPSLQAGARGASAAPGSDGSASLCASQPQLLGHGASSHRVPPSHLLHASQHLMHAPGAPNTTLFQPGCYGTPGGATLPPGAPRMPAQRNVSASLTGNPQSLSKNEILAPPLLPGAAAQGLVTLPPGQGSGSSGPSNTSPRLDLYDPRNPLSGPSFSPVPPAVSAPGAHPGVVAGGHSSSYVMSDGHHLLPGFAHPQAPAFSASLAHEAPASAPGAPGSGRAASGGQGLWVPGVPGAAQAGPAFVTPAPGPHQQGRSHNLGRGSDMFSPQGFGAIMPSQPGGRNGQRFGVMGGGGQPGAGAPGGGEFYM

SEQ ID NO: 902 - protein, 1546 aa, Neospora caninum
MSASGHLRRAGPPPGSASCWRAVRQPSRSLHSDARRGATSDSLIFRYGRQGTRLSGQFLSPVQVHGGKTPPSLSLIDHSAVRSSIRQVSVSPSCSSFALPSSFSRSPSSSCPSLSPELEQPSCRQRLPFRPGRFSVFLDVASRPLSHAATPHASVLRQPPFPAAPEPASSLGPGETSELSAFREGPPFSFPGKRQPAGLPDTQDGAAEERKEREVYGAILERYRALLYAIPHVGASEQKDAHAHEEEGLGDGTRPEAVGHGLWGKKANRQNVIEFLVASEEGLRLCDTKGFVDIATLPVLRLPLPPPLLSHFVRALVEVALDSPSLRPLRTCVEKLVSDGENHADQSEPPAACSPSSSPSFPSVTASLSPSQSEELRLACSQVEQAWGLPRLVNFYIIVCTLDRRGVLRDVPGGSKLRNMATLGLLSTLKNGDGERLPVSPAQLLQALSSTPQGKGDCHTTALERALQGAIARRLIDEYSAPTDESFERQEHLVSRLQFLSRTLRAVLARQALHSSLLPALEQSLTGVVRQLETEHTRLRRRLAGDAKAQETAPSLSALVACHAALLPSLADCVVASELLQQRLSASTKTEASGVDAKQKTELFSGRGELNGHSRTVRRGGDSGRVREAHENLRRSFVALQTQVFQAARQAVEEDAQLGHNGFTQQLVRYLKEPLRAAVYLQQNARKMEMMNGNAVSHRPLDVEFTRGQHDNLSRKHTESPLVGSRIRRTRVDESAAGEGNAWKRTESLLDALGGPLVEFLECLYTSATVRAATPVGKGHTGFERTSMPCRAEGTSASRAEPQPKWTPASSSFSETPAETAQEAAAPSRVQTAYPHVPPNSPFALLATTSRLPEAQAVASSTPQAEGGASLQAAPSPFTSYLGAGGTSHALGNGESVRPELAVDGREAAGRRGLLDELQDEGGVLQLASVFLRQSDADCGKLYDVLLPLLPELPKPCLLQLLKILSQVGLLPTLSVESPPPPISAAPAATPVVTASPASFLAAQLAARLVREPSKKAEEQTSWSEGEKSPAKSRERSTNESNASLNRGESVANPEVGEELQPGVGTPGACAHASDARGDSGGCLSQENGAANPPCHPDGSRPMPLFDAIVAELERRRRCAGNLSGNSRRQGAPPEGEEDWMSVGDLLLLSACYGTKEIAKEVRNPSSLVFFSDSLPSLAAARLQSLVQEAREEKDKTPGEQAALLVARVTQAVEAVHRHSACMPHAASPAKPSLDPCTERPSPSAAASDSRPDATAFASSPFSPSRGLASMEMSRFFEVAANVCSPLVVNLPAASLGLLLGALSRGTFSHTQELKTAGAGLPGRESWAESTEQTEDALRMWKAHAEVHNGVAKSLLQRHMVPMLTSGQARLFLLSFLGLLQLRDGLVSPVGRAASEKPLGEVPVFASAFLQDAHAAELWRDTQETFEAMFRQILAALGSQVRSASAASDDDIAETLHLINAISRLSPRAADLLDTVGLPLGPPATSATGRSRLHSGGGSLGPSVSLRERRERLKAFFQSPGQLDERRAAGASVSGGFLSRWLGRGW

SEQ ID NO: 903 - protein, 962 aa, Neospora caninum
MESIGSADLSQLDPDCIVLVEDDTSSRGSGVVEGQRLGALASERVQQEEASLVEDQVTEEDAMSAPSARDDNEAAIKGRLREIRQRLEDVESHIAILKTERVQLREEEADLTAQLKRNRSCGAQRCTSGSGEQSPQEPDWSSRDFPWTPALEKAALRFFGIQDFRFNQREVMNTVLSSRDALLIMPTGGGKSLCFQLPALIHGASSHLTLIVSPLLSLMADQVAALRALRLQAFYLSATSLKDEKDEASGVLKSLEGTSGCSQTQKRQKTEKVAAVSPDQSSDEPGAVFLYVTPERIAKSKKLMSQLEKIYAAKNLALIVVDEAHCASQWGHSFRQDYRQLILLKTQFPRVPLLALTATATPPVVDDIKKMLHIPHSRVFRSHTNRANLFYHVVHKPKTSEEQIRLIADFIRAFNGQSGILYCLSRKEAEILCVALKHDFQISCAFYHGDLDANSRLEIHRQWSAGYVSVVVATVAFGMGINKADVRFVVHHSLPKSVDNYYQETGRAGRDGSPAHCLLLYRPSDVSRQSVMVYWEPSGLRLLYEMVRFCSGLEPLSSDAWRGGRCRREAICAHFGDAAVSCERMCDRCAVTQLSPGERSNAVAVDSTSASRQETAVKRVPERTRGAQQNSGEVNVGALREAVGMMFRVLEGADEKEKQADAGKMTLLQLQTEWKKKLKRKDFGSRAFPADADVLQAILVNLVCLDYLSETFSHTPYSTNSYLRLNPKARRCLCQLHSHCADEVLSDIDARILAGSPGFLTNWNDCGPVRGPQGHPTNCSPSQSRKKRDGGATTDGDCGATLKKTDLQFGRGSKYTGVIRSTLEQLAMSMGRQKGVYASCVLGNSEIDRLCLHLCGERSDATRVAQRYAEGRSAETGVPSQQTGTDDGALCLESQRAAGSWAATLQAAALGSSVKLPPPEVILGPVLAARKVELYGDDIVRACVQSLRKQPSNALSCHILQG

SEQ ID NO: 904 - protein, 724 aa, Neospora caninum
MPHFPPRVFTSRMALGGAASLCPPRSLCRFASAGALSSPARSAPHAPAIHAAFSRRSAEERQAPSLSRNGGGDEGRHLSAFLVPKRDRTLHGHGLLGLSHPGAAHALASVASAWRSGRFVSSNAGEGRRPEADRTQGTAPAAASRPTREEIASQQRGNYEAENKNNEKNEGNEKARVESVEAGREGGRSFRRWFARVFYSSLLLVGGGTAFLFFMFPSAPLDLKNGALSSILQAAAALRGQAKETPGEETGDGAETASGGGEAQKAEKRSAFAFLSKKDPLEGFSLVTDAEFDSTDEALVLFVDGETEAEAESENIRKLRSLVQRMQQDGKLGKDLRLFYAWRTPGNSPSRGEDTAVMLYKGQRRSRHALASLVREGVNTGARSTPATGESEGEAKAEEQGEEGEEESGEKILEIFFTPLSEKENTTRTKREKEKLLPVRVVGSAFKRDVRDEAKAGNTILLQLFEDSCFLCFLMRPFLNSVSKLLAEYNIPVAMKRLNIEKNDFPEGCVVTRATPTFVLYRGGHEEAEKWTEFRPRDFIEKLEKEFDLPVELREKLHALLDRLHERFKRFGLLSVWLLEVRKMEEAFLEHQQRNQERESLELHARGAPSAAGDSQEGNSDATKTEEKSREKEDKQREDGNFDAIVSMLMSQDMKRYDDLEENLDHLEREVANAEADAMALGVMMGEEVVRDDVEHLAEALLEAESRAGEGASPDGRPQPERRG

SEQ ID NO: 905 - protein, 5715 aa, Neospora caninum
MGNPRAGARGPASRGLSLPGTDGSATLEARRRVNLQTKCFDPTTTRFKFLSFAEKLQIQLKEQTSPLHSTGLLDLLEEQKALLERSVGYAGFGKRTRADSLFAGDAEAEEERRKRRRTEELQFCALREVIRHLAAVHHPPTVSALLSELAPLCDSLPLLLFHCERILQSLLRLLLQDEAIVVVLSLLQALAKDLRSEFVAFLPSVFSSLLLLSRQLELTVDAERLRLLFSCIGSIFRYLARPLLRDFDFALALFTPWLCGDDVPFSSESEATADETRAGKARAGRKLAAKIGGLACASSAERRRGAAPAGGQKPKAERRKEAQTNISEEAMLSVGKKGKTMSNEIRLLAARAFACLLRKAGGVEEGDSGDLLCCIEILFRHMSRCSPSAREAYGESVAVILFESVKSVQLSFKRPFECVVRFLFATVLFQKPYAEQDGERSWSASLHSLAAVPGDEEEAEKTGMQGQTDTEEGEAREGGANGSAERSAQGRESEEESQNGVGDDLFALYRTQVQCLVSFLLHARQHTKSLESPGAQQIETLLLEFVSVAVKASPASLLAALSRLAQPSSDLHGHGREQAEDGDARTGDGEGHGGCASRFSPAFASALASPFHTYFYNFPVPHRFIDHPYLSGATRPRSPLFSTVSRALAASSTAAASPPACPPAVSHSPASSVFLAYGLLTLIEVTGAWVFALPRLEGSLDSCLCRLLASLSPGLLHKGGADKTDASKKEKKKRARESSFWRASATEKEEQEIEKAPLILQPLLAASVCLREATLRQADAEAGALQVLPLKSSAPWTAAAAGPWTRPNAHELELLSFFSLLLPCAVLRLLSLLWRAVPLSFCNAVNAVWASPSSNYFGGLLFVPLNFLSAASSPSAAALARPEASAGGLLEAYVNCALAYTSMLHAHLAPFKEETLRRHDFVHGFGVYCLRPTCGFLLRLLASQCLPAVSPAPAVASLPASSASAAPAGAALEWERSAAALLLAQQVEEYLEASPSRREAPSGTAPAPLQQTEERHEGRLLLLQTKQSLPELLLTVAGRLRKTRFAFERKGAQTQCATLDQASKTSDVSAADTGSPSHFSAAVAFVSASEEPGRAAANGRLADNDTSRERRVTVTEPTRTVDDLACTYSMLSSLVALLQAVEVHKHVSGEGEEGGERASDRRREDVRRNLAVVEDETSHLISVLLVWLARKLLTLPVDVQLHAHREVELLPRDCSLSCAQSAESGDTPARVALAGVEGEEWRGGEKDVEAVLHLLQFCFLCLDTVNPLTVRSSREPQREGKQEMVGGDPQGQDSSTNRSAGGLPVPPLQLLDMVRHVAEKVKSKADRTQEPCPSFCLRSVISSSASASFSSSDLWLAIILSLFSSGSFLCEQSTPAGSSSPRPAVALFSPLLRSAAFCLSSSSPASFGARPGVDQIQATDLSSRFPPEALARLRDVVSPHLASILSCCSSSHRRAREDALFLLHLCIPVLCLPASAASASPASARSASNEEDSDLLPVRRAFQDACSAHLQALLSLERIPVGLDTERKLTNAYDALSRGASSIFAQGLILFSQEVDAEGAPVTDKPQDDARAMRSDALFAQTVAPILEATVRILVSQLFVKFSPLWQPAVDAVLQLLEDIHTAQAEALLAQAFALTSSVTPPVRASAFAPADSASWGSSGNGRGTAGSDPPSQREDETPSSVSAVAASLLRGGAAEVSRMQARLSTALLSTTWEIVTAQVTQAVSELGATRPAKRAPVAPVGCRNAEACEMRSGDASRTGAEREETEGPTDGARRRRDVEGQGTGGSVKANAFSQWFVRTEWKRALGDDEEDVTDPLSRHTRLLRLVEGIMGSYGKDAFVASRRAEDAAAEAVKEGNEQEEETEQGSSKGEGSSKGEGSSRREGSSKGEGSSKGETAGDNASANEVTQTPEAGTKSAGDVGSTPVQGTKKKTRARKREDSRVLSGTRHGILRRREALRRFNWLLRQTLCVVETLTEGGVDGAASPDEGHPRGGGNPDIEAEEGEEEETPEEVPTSAVASASRGEDTTGRGNDEELFRTHTVSLIPRACDCLRAVVALARVDAKCFLSPSEKRASSSGSNQSVVVARGRETERKGDHAVDDRDERMALFEEAAEAERLWSRLPAVCAQRLVTIADVSLQQLVIQVLQLSPALRPELAPYAPLLLQLISEKSSSNALLRLRLTESEGEERKEASAVDGTQTKPETPTREKEKGTGAELVVVQEQHRHLIVPLVVRILMAKVQHRAAGRSAAAVFAERRNVFAFLSSVAAAELPLLMAILLYPLVDVRVTSQEASTADPSPAPPSVSSACPVSPCSPASSASSLSGFLKEQYLCAFVAAQLNASALSPQSPLPPAEHPKDAVLARQTRPVASPAVLGECTVGVGGDGSERSTGADKTRVTVSLAPCCLPPNVSSRLPGCCKTLQQLQDMLKRLLFPATPFLLLFYRTLLQNIVCVPAAAPALTSALSTAQEGGPRAEELAEPPSASSAAGRAYVKQTVHLCLVLLRQLLELFPEVSAAWQDILKPAGPALQQLLEAAVATAAASPAGGRQRDEGKKQKKNLPAIVSLVCSWAAQPAYFSFFCSVVPEALPTLFSVPALPAVLRRVAPTFAGLGRKAYSSGHLGRGSGGFAGGGATSGVLEAVLDAALLLSAGGLDREREETIAASFQGEIKDLRRRRRKTRSRGRQASQGATNRARGSALSSSSSSEEEKEIWEEEDEIAQRRQELLRQQRELEAEREQHEREGMATLLPHVGRLLASLEVLFQHRRMAALGGSEAREPSGGVGASGKEREEKTEREEMDVDSDKSADEASKEAGEAHAEEEKEDGQEREEEAFTSGPRRSLFGVVRMKELQLLTRIARYAVEDGGTSSPPPAGHATLAPPVVPSPRDNGESSAGVPSPSLFEPSLSLSPLSSSARQERFSVVLRLIRLLVQSLPSASVLPSHAPRLGTPSSTSRLLLSLEALLQLAFPLASQVRALREAEQAAQERTRTPTAESPSRGVPEDSRPDCGISEKSGNAVSPSASPSSPLSLSELKDVLTAMYRHCSVLLQSTVSSACRAAVAKLFVAVEFAACGVRLFSSDEELDAKVATQIERLLSRPTGPVELGLEDEVGVEAKGRRLVAALVPGGSLLRALLGEREETSGGDARTGKAVGAAGAPNSNGQSETQTPVFCSLLHRARALEEGGSARRQGPHGSPSDGAADVETPRGSEPAPATPAVDSRDLLLSQWRLSVALILFALNSRRGQTSLSRGLALPLLADDEEQPDSSMQLIVLPALVAGASIRGLPASAPSFSGEEGQIPPPLLEPIIRHCLFLLAAASVEWSVQQAAAATLKAVVDSVALQAPKLPASASLSASSSTSVLQSVKLRMQLLARLVMPSVRAQLKSPVDAQQRQGLHFLAYVVRTLAPVALRLPSLSTGSPASPDSETKRMRQLDKTFHLDLSVLLSVPPKDATASLSVSAGGERSEEHAETLECMEPRKPKPGTEDAGGDFFRDFLHMQRHRQGRALQRLAQAARQKEIGATTLRLVALPLCFSSLLQRASLRPRSEEERKKKNNFLRKEVFHQGLAEQAINCLEACSHRLKWPVTLSTVRLLSRFLSDFPEREGFLFRAICGVVRAFEAHVKQAVSEALHGDSGADGEAGKEKTTRGRKTAGEAERDEDGGGLQGHTTEGAQERFSEEDEDEGLSESEDEEEARRQDRAQGQLRARHRLELMHARMKADLLPLLFRLAFGGSGKKPSAGEDQLVASQTGSSQVRSAQKDHEQNVRPPIVAVLLLLIRLLPSTDFYQNLPKLVRSVAFNLRSRDRDIRRKARGALVSMAVSLGPSFFSFLVSEVSVLLRDRKPSSKKGGAQEEDVAGNSAQAFYRPVLLFTVHAMLKGVLDEDEKKRGDTDSPLFDEKDTKREEDGGIDKALPLLLPLVAEELSRVSDPDRPFQDPSTTRQHSKIDEARHLKGPSLVFLLASCSSSSSCASLLLPFLYSLLGGRRRQGDTVSSAYSPAYLERVKDLFLHFVKGANKNRSLSPFFFFLLSRRLLTLTVALLQTQLLHPLQLERAGRKREHLEFLLAKQELRRQQNGARRRKAKAISSRDASLPAPREEGSLLAERSSPAVPEDRADGGSRKGREAGDGRRGCEREAAFREDAAFFYCMLLKSVVGSPDGGQPKSARLPGSSEQSAPGEGDDEARSDEEGAAGKAAEEDADLLHAPGSLDEAMALARERRLDGLRAAVAAKKDRAMVTQPGAAKGISLEKALQRKGVDVYTRQGFDSTSRATTVGFTGLRLLLSALKRWKFLVRKTQGKPEVRPQTAQGNLRAELEKTVFALLICFCSNITELISWTMRCLPHLLPLRLSALESRGAIIANTTLRLFHNTGGGWASRRAEDHQLFLACSRLLPLLLLHPQGDKWFAAALNAHVRVPQTHRQLMLLEMERESARRRAEQKESAHAKRGDAGEDEESDSSSEEREESRSDKEEGDGSGLASDTGEADGTRAGRRSEDEKGEGEEALVLSETQLRLLREEEEKSRRGKSGAETRLEENFKEALLAQILHALESPQLRLSGLMLFKTLVLPHYRDVAAAALTAEGEGDKKGGTKRDKSARVKKPRKNIGDCTLLRDVYRGIDTIVRLMIQEAGEDAEGRRLAAICGDIYPHFLLNFPMTEKTQQYRILFLIKNLHYTAPDGRRAVLNCLHKILVRFPNELVVSRYSEVFLLALAGRLVLEEDRTAHEMLRMLLLLLLDIAEETDDPEHSAASLFQTAVTVFLQPEIPKIMALQEFVLVFLDSQRVRVTSILPRVLPLLHRMLILASDSHAREGFAESRELFPASRDWRVTYKALLAFEKLMFFVHPSQLEALFSRAARATPGSRGGQPFSVVAANADEDGNDEARGESRVGEQLETQVAERILGACLFSPASGIKAGSEARKTAHERLLVDEGVDGETDARFSSASVPRKDLLLGAAVGRLWLEAACEGLRHEHPWLRAVSLRCVGAYIAAKPARSYSLSTPCLLYLRGKSPAGSKQPSREDASASPASPGADLALAALSPFCKELFLEKNPAAVLSARALILPLFQLALNRPDLVFVPPRPRRSRAENGDEGGEEGEDVEEDVDERQTGAEEESGGSEEEAGEEQEAEEENEEETGDEGETRDGTLAPSDEAEEAMDEDPLESSLDSHDTQAHAGKRRKLPSVPKKESHKRVQVAAAPGSRGTAEGAEQGGESGDEQDGNEETFGASDQSQQDEEEEGEKEDVEEGHKGSERDASGSDRELEEEGEDTGDDSEDDSEDDREDEEASSSEALTLQVLMRPSDVLSSPSENASSNSFAAGLREDSSTDLLAFENKAAALACNADSLVFSGGGQLPRPTTHQGERAKRQRTNEEIEALPEADKGRQGQLNRGETQGDSLSSEVLAHLSAVSVPGRESAAAQNENSHPLLFLVRRLNFWLRRHLGTLGAHRRAGLKKGSPTTGREGAQKQGEDLCTSVVRVGAILSVFQSLIHQLPLHPSQSLPYSATASSLGSSSSCRKRKRDRKEGRQGLEGTGEEQPYSSLNQLFSFSERHRERLLFLIVDAVYRCSTVIRGGEEGGHAKETKTDSVLLQLLSAERGEGENALVGAEADGGSSVASLWQALASLSPREQQREVLTGGVFLLSEIQDVLKEGGREELALTLLAQVRTSVLSRRLKRKVDSQQQALLQPQKYAEKRQRQQRKKKLSKKRKIALLIAQNRGGKRREKA

SEQ ID NO: 906 - protein, 3128 aa, Neospora caninum
MFVERLLHVHHGGLPITSLDFQPHAAPWGMERLATAAANCVKIWVLHSHSPSLCRALLDGKSAGEDAASSHKRHKQAAPAGAAATETPAEEEQSSTAAASPVVNASPGEPPPLSRPPLTVATCVWTASEHRSEIMTVRWAPTGEFLATCDADGNLFVYALNLPLPTWPGTKEVRADAVKSSASVAAEKAPCAGAREEGTPRRGPVKKGKQDAPSSSAALPCLCASLFPSSGQVPWQKAGHQSPPPASGGPSGAGVYTEKWRQVSACLCSAVGHVFDMCWCHDSRTIALAGAKGKVCLVDVPRHEIVTVLSLPGGESGMIKGIAWDPQASLLAACTSAKKVFVWRTQRRTQTKLGHAAWSCSLVYQHDELLLGGPSETPGPRRLSWHPQGTFLALPFAERNGRVFGCCLRVQDDSELKAETCEVENAPANLSDASQAGAGRRKQLAEFREEIFSRLPPLRLRGHRRPIRIVRFSPDLLVEGGAPKPSPGGKSGKTSGSSSALEDGPQDGLCCLYAQASVDGALSIWRFSTDRSSPPDTPTKSPSGSRAGEKAGEDGAGRRPAGTQARCLAVLLNFLDENTTLHDLAWGRHGQWLAAACTGGGVTLVALPHAALNVAFATNWMAYQLAAPETAEAARASGESRAPAAASSPSVAASCSIFNQKLRDPPSPGSTAALSSAAALPQAVPSCSCPCKCCCCSLHRHFAFVPAPPAAAPLPAAPKKSEPGKNEAEEGKVGRIQIESVTAGGKRRICPVNLSGGRPGMTVVSVRRETPGPAGGEASSADVGRTSLVKKEENHAQAESSGLNSKLTTTSPPGTSPAVAQPAPSAAAALSRFPASPSPLAASTGAAPGALGASPQPAASAAVQREAAESDDSPEDGSFLLMLQRQGEEVQRVLQRPSWRPAGVSDSVAPQRDTEGRKLSLADVLLGDVGDQPSAPSASDSARQPPLSAHPVRTQVSGPSSVSSSLAKGPPASALQTAFRGSARESGERAAELSRAVGLLARLRADRRELELAGEAGEEPSKAPSLSRLQQAQQLLAAHAGARTGGDTAGPGAASGTGASGVASLLSRMEAAETPLQRREWQAASANFWRATRGGEEAEGRNVREAAREPGGIPLISLARLPELGAAGGEPATHKMGIAHPSARPAGACDLVVISSGSETDQEASAEDHADREAARAPGTRMQSESICGCVPPNLFLEEPAVSGGVEKANARLAEGEAAAPCEVENGDNGDSRVARSGLVAAPEPCDRRVYAWFRELLPFQRPPDEDGRDSRLTSFEEPGEDDWEEDRAVQVELATVAIHGRAVPEGFGDAVCFGARPRESAYRPLGSGVSGGTPRKGRAREHREAGAAGRSEVLAPVASETCRLETRALRVAEGAAERGRRGEGKAARERWRRSLAEAAPATRARLDRGVCQAAAGSGNGGAGVQANGSANGGKGAAGGRESGRSGDSRRKGFVGGGSGGHGDGEDDDAEFREKELRKSQFLSALNNGGSSKERGDGEKDEEGKKKGRRGPASLATSGAASAPPAEDSGPTRDSAPLAAAEKGAAPASPGEAWGSWNPFRRRLQLLRQFEEEEDEDDEEEDEAPAPPTTHRPASSAAASPAQADAPCVNGCAASGGGDVPAVNAKSADGGDKLQGANEGRRFGRLRARESEEQEERRRPGTKSALSSCLPSPASVSQPMRRDRPRARPASSAWSVSGEERDTPASDGKRRAGTRVGVVALNFLAKARESSQLPSFFSRSLSPALGRDRDMRGSADERSDRHEAPGGSDGDGPLLCCSMLRRPPQHGEDSGKREDEKENLEATNEEILWIRRLPAGLVVTHLLPSPTETPERGRSLLKAKVASPPEAATDPFLLPPSRVLLVVAQAKAALSAHGASADVLSLPFPSPVSSFSSSVPGLCRRRPSKRAGRLDSAFPDGSASRWREVRRRRLCRPRAPRPSPAAGVGRSVLILVDMKTGAMHAARGSDLSFSLHEPICVCRWVELKRRRPIPLASVSRPSRGLSGDESPVEKMTADQNRRDVHEDKAMCVEAETGEATPNGSLSVKDGTSSLCIFLLTAYAKVFLLRPCEELSFHPEGFALGPLAHVSVCSRTRRGSSALFGGDLNEEALRRISPSLFLDEATWFDGRGMARGAHNSEGDQQLEAGRNLERLSLLPQLSRVAPRRALALHDSAPFSTNDATQRPWSEGNSRSSASLTVGGSVVLSLCYYADLSALCRGEKAQVESCEERNEGAKLLSGRSRDTKRLGASARVLPAGGKNAVETPSLRDTVRGAAPAKILWIEIQQRSPSLFSLLEDAEAAGVPALSEQTSHGETGRNREGADKRSRTLGDEDRGGRDAREAMREFFDLTFGAADEHDWIQLAIGLDSGKIFVSLPPGGRRALGMSPLPPRASSQATADAERDRYLGAPFGGDALNGRRSGSQGRERAEDAAHCMQQEPSSWGLAGRSPCDGAQPRFVRIDDLAFQHSDFFSLLTWPAHGVVSEAGCRPVAQLRDADGACESPLWSGGESATGGGCTEVSAARLSLEDLQKRVALSPAVAPAFAQRVLISTLSLPNPPASASASSGGASEVDAEREKRNARGAGREDAAAVQRKQLKKEVDSQRTKFLHFLLQGRFLGPQFAGLLGTTPQGLAAMRREAVQELLSSGQTQRERREEIDEADSREGDGAPNEGAEEREEETGEEEERLACSERCAADRTERDGTETGEGTLEGGEEGNRDNDEERGRSGKGRGGDISDPPSPGEERREEDSQYERDGHSERASRRQSRTSAAVEGENATARELRVPSQRLTVKHLHHQVWSALAVSSSSEFLYWLSALLRRQSELRLLPQLVSSSLFLLSAHLAFLRRLLVAMKTEQRVLAQDLRSGARTLRLLKRQTSPAFAPSSPGVFSRDVVAFSHREADAEAWRLNPEEGAESEELNPGSEVIDWRLLAALRLSAEDVAASILRVLETLHSEEAKKGMEEREGKAALDDRGSEKAVSGNSLRTNQGRATSTIHEGTERDDGVDLEKGKGDEEDEDADNESHGAHSMSARLEALALARERVRKTLAAVQRTREEVRKTSVSLSLYQEERKALMFLLGATVVERYRAEGKRKKRMGFFSYLPLSESSDDTRRDEAQARREEAEAFMEDIF

SEQ ID NO: 907 - protein, 1726 aa, Neospora caninum
MALQRLREVSVRPANASALLTPVGPAPLFLLVSQALINANEEDLSAVTDCLSAWHTSNFLIQRMHSDNDWLATLTLQQEQLRNLESERAQLGAQLRQSRTSDLDFPAVQADWSVASLTVEANGNLDAADAGRSPVARQRRRLLRTRLREVEEQLYATKIQMADALGIIGLHSLRESLLASLRFSSSASPLPYTPAYPSWSSTLSFHCSPPRFQGIWCRAGGADPSTAAGTRPLWASIRETCTRFGEDREDAGADCGESSRAWLEKKFECLWRLHKWDCGETTPLGASRTEPWSSLDSGGEQRDSFSPCPPDSCGETGQNLSLFNGCIYSTLSLIHGAASCRPSSSLPPRASSASQTSNSDVRALPSCLEGRAPHVAAFRRHTRHCAVPTTGTLEGDDEDDEDEQGDTYDEAEELDHGATSQRVFNTILTRLRAVQTSRHALAIALERLASTAQSASSAVSSFGPSSANAPDPSLSRRLLSAYVELSMAHALQLATTLNLRLHQGEPCQDAQCDAFEHLQSSWANDLAVAAGPPAACSSAAASSPVSSLPFFLEPLVSLQTSILEAAIPSFHIYPRAPCSGEFCEHWAPRGTHAGTGSVHDQQATRGTERRRRDRIELEGARACGCHVRRPAARHLLFLAEMKRERGDWRGSLENLLQAKAHLLQLQRDRERPSWEAFPWQLAKTLYLAGDRSGSLNIASRLCQPKNWPMLPFQNLNATSAAGPSCATSCGGAGAPAAGDARPSHGCSPQASFKSHSFANRTSSLWETKPVSRTEDLDGLAVQKFRGAMIDALCSCGEWQFRGRWATEATVRRRYFSLALRLGPVSGSLEPNQRLATLIDDQLQSYSDYKHSVPSLVMADLRRKEKAEIESLLQQLSSAFEERGEEEQTRRAHAQQKFLQHHIDILLQKQRVLEREREKEYQERTQWALEAVTLYATCLKDPFLPHAAKTTSRVLSLWFEWGDDVPEMNAALHRLLIAPFTSAQPQHRQDAGHSSSPFDSSFSSAQRMNEEDDSRVGGPPDLRHLLPFVYQIASRLGSPAESPFQRTLRDLLVTTARQYPFQCLYQLVAIRNGRRIPPGHRGADSFTVQQDKIDAAQDVLGRIADSSPALKFVVAAVECLVDFYNDLCLLDFDDETRTVQKKQRSLPLLQRGSSQSFPRRLTPQEQMIRLPSFQKLEEFSALLPIPTVALPRDRLVPFQTPETLSRFKSAPDYLLHLSSYIHSLHPYCLSDFPGDRLRMSVKVIGSGITKPKLLCIWDRQGRKHKQCCKGREDVRQDRVAQQLFSMLNQVFLEAPSTLEKNFYLRTYAVVPFSPAVGILEWVNDAVTLAQYLIGSPENGYHGAHARYRPQDWTFSACRHKLRLAREKALAQRRQLLSRGAGDDGAQQKGQQPTAVSRADMGPDPLVESLVQAYDEICGHFKPVLHYFFLEHFPSADAWYAQRQRYRRTLAVSSMVSYIIGLGDRHTNNILLDIASGDLIHIDFGVVFEQGKLLAVPELVPFRLTRDLVDGLGCLGVAGCFKRDCETTMEVLRRVSPLVVSIVEVLLFDPLYRWCLDPRRILQESDKSLALAPSRPGSDAKTGGPKRGRDATSRGRGPTSTTSTLPVAERSRRKRGRLEAVPEQIPSGSALLDGGTKGEAKRDPEEAVDEARGKQSAKDIPIVEDILTKAEGNMNAKRAVLTVRRKLEGYEEGEIAQLRVNAHVARLVNAAQDRTALAQMFVGWAPWV

SEQ ID NO: 908 - protein, 8792 aa, Neospora caninum
MLASAIVDLINNAASEFVVGLDSSQLDFSDLLSGKVDLRHLQLKQAVFDFLSMPITLLFSYIGRIRVEVPFFSLMTSPLDVEVDDVLVVLATHPADEWDAESFKNVYLNRKDASLQHSEFQAMFSAVEGGLTWSMLLTLASNIRAKISNVHVRIEDFHSRKNRPFSIGFCVKNALLHSAPKGADTSEPGFCTPSGRLQENTLFKMISVEGLGFYIDAIADPEWPLTRARPSGPTSGKRQRSSLGRGTSLSTFASSGSDAEKDEKGGRRRKASRQSRASRIRLLSQGSGIDSPSYDVGHYGIPRVPGESDNNYNRRMYESLMSRVLEDPSRETDAHGLYPGRRQRDSAGRGLRKFMRWDDREAEAGGSATVCGRCSALSLSCCAPNPSGSTGSLVFSSDNLERDASASSRRVTRPGGSFLAPQGAGPRYSVAYAPPLTVVPGRNGPSVEPDSRTGDDRLGEAREEGAQRQPSLSADTAASPSSVSSPQSGPRGRRDSVYGIGSCMQCRSHLAHEEEVVVPQPSPEVRQPHIGHVESWMPHIAEFCSLVDAKEAAKTRAHEAHRGGEGVNRYCSRPSFLPQNSQIPGTSVDGPGAAAGPAVARVRGSAKDAPRQRTVTGRLLSGKMPSAWPVSLTANDEYEQTSFLGGPGGSLREERACGGPEAFGEAKERRAFPSDSGILCASRTAGGGGARPPAMALSRQGQRAAPRVSFGDVERRDSSSSDVPEERDKEASGDPSAPRVFSTSSLTRRPPSLSSLSSGLSSPSSRPSSPPRSSASLSSLSSRLPLDRRASNHRAKLTSSSFLQASPLFETRPSIPQSLGSNLSLSPAPEGFGTADSDSRPAAAEAGGASGTRLRADSVSGAASASAAVSPVSPRRREDDNGTVFYDAVSTLPAMGAEVGRPTATSSRDFFPEPRGGTSRAGRPVSFAADRNAPGRGALFFSTSSRLVQPQPGVSRLNTVEEGSAPREQREARRASAEGESAGNVSSSGPRPSGAKADPPGREERRSKSIVRGLRTLATRKIAGRVGNFVSAFSAVSPGTGTPEGDAVSGAGTTRSFAVESQQMSTSSLTPPFAGLGDTDELEGDEAEFADALSGEEDTGEKPPRGKIDFSDVDADEGAEMSGDSTGAEDEETADAEDEETADAEDEETGCAEEKPPAKPLTLNPEKAESFRAFILSLWDIRHEYIVDPAVFHGQAKAYLSLVPTVPKGGPITRCWSAWGERRRLPEELTEALPSCALFVTFVDLKFTFSEAQALNMWKWLEYYFILYSMWQGGILGSFEKPRASLQDQELYLKAWPLKLLHATVDSVEVSDLDSAGADPATATEPKKPDGVSESTQTPDRLGAALETSETRGEGDGATEGDQEPPHDAARILSSSEEIAAFCRHFEATHSLQTIFILRAKAFHRLKTLREKMGVRSRPRGPLMRFWNFITLGRYAARGSTGARGSLAEGIVGDPEEVAKASRQFFEGLLRQNGLSVARMQNIREQSVSKDFLMDVVVFDTQLLLTFEGKGVAVPSPRIGQRVLALETSCIHYHLQVSMTGDQSITMDIELYPTSILTTGRDLESPYIPPEISPVMLLQPSTSRVHVKKKNNALVNFVNAVFRGGGAGHAHPGDGKTAAALPLEAGGASADGAAPGGSSFFSSLFGRGRCEEGSASERRGSVDAQHPPFAASPAHLSLASAFQLGLGPRKAKDEFDLRKRRDDIVRGWSPGAYMRIDTQLFHTLEKPDVRVLLHSSAELVVLLSVQKLASFFGECLNLLDEATTKELQMSSSLQTVTVLRQGEDFCRAVAEGGISHPNFHLECDLQKTVSAIIPRISSSLNCEGIKLNFGDLQAFSTLAPRRASYPRDLPTADLTDRYTCEVGGFQLVRLGSCTDDLSRLFMYLGGDLIVFPTCISNLMMIPVASSEKIEQRRAPDEPRASPPGSVPAASSRERPRRGGDGDTPRGGRGRNRGATFMSFDEFLDATDDGSGDEDAELADRDRAGTLKRRSERKRETAVKSGSRFVRGVSAGEGSDREGGRVQKEWKKEARAHERNTESLKERKQPEHRLDLIVCELDVEFIVNVLAETLDIYYSYSNRLQMILSALEDQDEAVWRRMQSLRKEELAGALERRRREKETQEESASSSEGEGCGEAIRGESAESGSSGDRKRRGYGARQDGGRGKREGLGGRAFSEGSCSEGEATEPGVSGHHAVAADDSLDESVNRLVQEQWEKMQEAADQATQKFQLGDTQAAAAGQVMRAVIHSSFGGIQLQVWRRGPTWRGTQGTGANSPFGRSPLDVLQSGPACAERQGLFSADELNGERGAETRSAADRGQSGRFPAYPNASLYSPNSTPSYSASARQARRGLGRGRILQTPGTLGAKGSAHGAGGLGLYGGEGNSTRRPTPYASVGNAHSADPAVNHIRAVLMNCVCLSHFSEGFGFAENQRIGPLVSVISLPLAVTVAAASDGNVSLLCKLEGVQIRDETNIAPLTMAYLYRGTGDGAAADRAAGLKRKDGDAHVAPAGYGSPSETGGRPHGGATDKDDSKTRGRGRPSRPLLHPGMKSGVLHASEDLGLTVAPADSRVVSLAVRSPRRRTDGVLEGTADSVVGRGGVREDWLWDRRAESRRGARGEEEDLRVESVGKTLRRHVASSACRSDFSLPVWSLPGRGSLLRCASRRRHSLGWDVCPTEAAAPTSPHLSVDFAGNFFSGVSECSVQLRTCRFVLLWEVLDEIAHWASDVSERLPTFPQPPPPLQRVPRASQLSVAASMGRLDRRNWSFDASRSGGAAAWQFAGTSPDMRSRESSAFFAPRHRFISSFSSARGDRVSDAYNLYQLSSRRGGGVARGPTASGRRLPAYDRSFRGEPRSGNPYRFSAIDSATVFGLGAAGSARRRRHSCPETVTPLFMKIMKDRHEGEARERDLLLPGYLHGQISGADGAEAGEAAAAQGRRQATLLVREGAKGGAHPSRHRVGFFAGRPREMSEGDFAEGPKTFLTLPTFHVPQLAGGMGTFKRKTRGFSRPSPLAHIADSLVPWASVRPSRRISFFNSTISGDASLRGSVSDGEAERLRKRGDGDSRAGASGVDTDSASPLATRLDAGASPGLNQDPSWRARFPLSTRGTGPVPSSVQVAPPPSRAFSYGNQERARARQSGNLPEWRNALVAQQTGKAVLDARSRGSMQSVSSFRTSLGSARLSHWNTMIDYSRLMQAVEEYMPWEAGDADFPDLPGDGLFPSCEGAPAELGSTVAPPEWELPSRGWGAARSRRATGRNSGSELFARAKNFLSFHVDFRMSVFEVWIPVEPLRMPRPMSHKLDERTLAARGARADRAAAAAQGPYFPASGRRPFPSIAEDGGYERGATRGPPGVVRGQVGKPLLTPSSRTSSQRVQVTWEDRDAGARDPTVARDGRATDAGGKPPGILRHRRDVFAKGADRAAPSTLNRAADESASPTAQSAARSRRHPGLRVGKKLLKEELFRTRKRRAAGKGGGDGYVSDSAWLCRGQGGTDLTGNARAARGPGGAQEGLKDVFAGAMTDVEKDARRARFVASRGSHKSSQATGGQGDRGYPVVGRGLHEEQAFASLLPGASWRGDGDSSSVSSGRPLEGSRGRDKLWGFFTGRDGDTASAGKPGSRLSARLASARARAHWRRLRLLARPPGRCSMVAARESKEDHGTFSQKHDRATDGVENAFPAGFEIGPIPTVLAVKGTACATLMICRLASSATQEAMDREEDLFAGRCTEREEEATVLGRYAPPHVPGRAGCRAPDSAAHAGPAGPLGRDDLFRRERGSGPNWSSAVTGGTGVLREGEDGRRGPSDAGRRQLSTGSERAWGRRWRKRASRKFEDSERASSFWVPPSSWYIPELRKAFAFSNPGVSSPLAAFGFLFPSMWRLQASFTDVVASSVTPSALSPIYPAAIPWVEVVTNNPLISPVRLSLGATLSLPHLYQMHERLVGIDSSASMTIYRAYGVTRPKAPEGLSAALQVEPVLVTMDCYSLLHIYQLLSILRGFGVYVGDLFPSCASADGTSDEAGDAVDRETAGDGADVLCMRGARARREDDSLATDEFPESASAGGRRDLREGPEKRADWGVPGSSGTGPHVSLDSHPSGPDARGRARRALSASSMRTKLALGGSYERAETLRRGLTEASSASTEHATGHSGPQSAVRTTAVLLGGEREGLSTSFRSFGSVPAVRRAGSEDGESERGASVASKPLSSLQGKASGSSLGRHASRAAAGDTPGVPVVGRRSADAGGSRPLPKAETLLCNFLHTFPVALTLESELVRIGFWDFYSVNRRCFLTFTFEDLSLGATTKSSTKEAPLSLTSLTVQAAASSPEVLACRTALSRMEQDRVQRERRIRFARPAQSPNRLLVTRGGKATFDTNDSDDGRTDQDGARLSTLERSSLATSGQWPSGARHLGGRDSQFLSSAASSRNSRWSSCLTENDPETGRQGGKAEYTPRPRMCTGARGSRGPRAADRRGCSAPPLSARPDSWLQEGQTSASEPGSGIGADISNAPGLSGPREEPSGTPVRGRGAQKRARSAETALPGDEANPRNDSGVEDPRGCRFGELTVRRRETPLSSVYADEAYYTEGWRDEVSLPESDDSFAHPSGAWAHRSIVKIPGAHRRLGAAEASPGTPGGAFPSAAIAVGGLRPGVTFVPGASLSPLRTGKVEGLRPRFSTKVGARTLTRRKAQGEDGFESPGGRTPLGMLPGRGGHLRLPLRPKELKKLLMAGYLEGAPSSRTPGSEGPGGGWRGYRRLSLGVGTEEESEADPEAWYASAGGQQREEASLLQEFLGWENPWLTLEASMMLELEHYNRIEGTNDLTMEPWQVSVLGSKASLRDSLDCDLEASWLNVNLNVALADAVLVYGYALIGCVIQERYALQLDRHKRWIQQRKREQEKWKSAKKDKDRTGVSVAGSDVKSAAFDDGNRSAAGYTSYTGERSGVAFSGSAYSGEKDVLEMYALTGATFLKPDGTLLHPDRFNILKCLFNALSLDFLGDNLVSKSSDYMHPSAEFAGDVLKKTAESVASARPKRHTGAATVLAALSVLQSPAGGAAAPADANGSAGGVDGGLAARSGPRAVSRALAAGEAKPTAPSLGALRADGFPLQAGGSAIGDSPGNSGPGGGAAATLADGAGGAAEGTNKRSLLVKRQSGPFSAALAGDGKTNGTGDGKGGAARRTREEEQLPQLFNLLGQTIAVLTDIVADEDSDQLQGKWTFVEDGQRMGLPTDENGVVETFVVRLRLLNYVYDLPSQLFQFTSETRDVIRLSVPEVPLPPRIHLLDADFGDGGGAAGDDEGLGFRSSRFSPQFTLGRLRASSTGDGGAFGPVSGPRSLQRRAFSRLSASGSTRFSVHEKITYPRERLWWDPENLPHPRNFVYMLWRTATHSASGGGTARYDLFLSSCLVVRNTTQFHLSIFPSVPGPTNSKKSVFAAYHRKFMHCPARPPSASMPVFTSVLRRYQGADAGPSDKWVQRRATRAQSARPERAAGALLDHARTAPTAQKAGITASGAPLKVARQTVRTVPPTLKLPAMEHYIIEDPSAGDIGRKFSMVAANPSSSEEEGFLSTLPGAKARALAAGVANQMNTRDDRAVRQRAQPTSRTNSRRRRDGAPKTGGASERLRPIRETETETGVPPDESAQRKPRNHTSRAPKSDEEGGSDEDASLSPFLYKVSPEEGKSGDGPARTREAKEGRKRVQLVAPDAKDSDDQSEGARPAMRNGGFLTMGGRRFTRNVRRKGRGNKRGVSKYDLYGGEFIPVVDNVDCIELQPFDSMVKAIPLFWTLTDNAPLWVSLKKHAPRSKAEVRKIVKYPAKCDFLTEEQTLKAICGNALVNYRPRKSQLPPYQVHLDGGDREIALSSSVRGVSLRCNRNMIKDSRIPGLFFEVVLEHCLVICNRLPRTLYVRPLVSAAIQQREGERDPSVSQVKETDYVIEAGESVSFAADPAALLVLFDDLVSRPLEVAYKAQGTVVQKLYMDVAAEHHTPFELHTADGRDARQPGRASPTSQDPSPSDSIEGVATAFLTDADAVTLSSESTPESPAPSEAYDRQGARRNTGFQANAQREGRRHPSKNAPARPTKIPDGPGDAAQRHAQDATAPGSVVSAPPQSDLESGSDVKEGCRPARVASPSLHASGPQDGDDLLASLPKKVILWVQLSDQAGNKKKAAATAFKFYSGTYVRSVTVFSDRVDNGALQLLESFHRVVLSQDFAASHLRLGVPCSQYHRIQDFAVYPRKQPDRLKACISAAFMMQRHEAAAWSNDFVLSDMGTVGLYMNQTEQHPQLHYTVAMSIGPAPFFRTTIAEILPAFVLVNERQTIPLWIRESSAGVGNSKATSYHRIGPGELLEFHPQGRQPILIEVTSMGQADLRAELENGEATPTSVSGDPEGRDLQKLDEEASAEDRVRASDRSASSGADCATFDLGPGDEERGSKRSSKADVGGPEQNRTRERGLKGLFEARGKMRAWGGDDHSAPAGDEESSKKNRFLGLFDRGEKGKDEVKCDACVSSEALPILQPRGPELVAAEANLQSGPSSPARALPAVRGPDAHPRSIAQGNRDGLTDVSPRNQGAPASEETQQVGHGHGRSLVSGEQPKGDGRSVPNDSVEAPGAASGARSLFHAVAAHAREDPALSSDSGDAWRALDIEDHWATFSDPPEPPAAVPKYRSVELQHAQRSLADGSKVEDVSVRIGHAEAAHGPGEGAAPAELRLAPHASGSALAVSASRAEVTASLHPLSRGNTQGSLASSSPPVSSSPTSERISIPDAGNKAQSRHSSDTDRDAASLRRGETRAGREKNGGSREGDTGGAAVPAPRSSERPSGLVTGSSSRHVRASSNWSFPLEITYARLLQIRHPTDASDAPAAGPHAHVAGKPAGLFAAPSHQSESPFAGSGPSAGLDQDRESDLEASGSDRDRPRRSEGGHAATLCAISVSSQEAKGGRLSPGNASLHSSGVPHGLAGGAAALPPPAFGVTEMEVSLYSGSRFVLFLDPAIPDYILLNKTSFGLCIGQAGVPAFGELLRPIPRQFLSRKNEFVGQKFGLKFALYDPTKEAKLDVWLSSELEGRRPSSRRTHSLLRNARLASKLKSIPGSSSHIFNHLTSEAQRLTRRSTDLLRAGTAAASLRGSAEERKGRLRRIGTSTYSSGASYAPLKNGDASGTRRREIDRKGESSQDLARPRRLSSSLFSAPNIFDEGGDTGRGSGEDDRGEKAAAPSEPLRAHWGLQGQSHRSLRGHSLEQIRSKISTARCPRQGARSLNSLREGLLRFGREGSLCGGHSSPLDMALEQDYRRDFAESFELPCSRGSNLFFLVLTHPISGARVVVCVRKKVIAGSTYIIFFEATRGVRADRAGSFHWADPIPGLRMSRLYPGELRAVAEAMRPQWAMAELRRGNHLIKPALHKIGSAAHSENFHLFQRGTGGHLIGRVGHRIEGVAGRVGGLVGDAVDNVKGAGEASRALLYALGNEAQCFALESHPPFGPSLLAAERDHCTVDGDECLDSDTDDEVSGAVISTDLSINVSLLGAGVSLIDSEPNEILYASVEMLGINYDATNETQRVRLTVGWVQVDNHAKGAYYPTMLRPITDWLTSADASQDAPQEAPQGEGGKDLRRAEARLAVAGPAPGREQEGAKAAAGNGDFAGRRREDRDGRGGDPEEDWQAPKVGDAQEPTSGSWCPAPRMSPFVLPAEAGRVEAFGSGRDARRNCGASGPRARRPRRSGNEALLLGPRRQSRSRFGTDGFGEHGDAGWDKPPWARLQPVDMLPAQVAKLARLHHSEQSGRLMDERDAVVQVLIEHRTSFQAGRGLVDMPQCLLRLEPLSVNIDSQLVFAVLLFIDDLLRTLNVDLLQQSVKDIRTSEMDPTSPVWRALLGPVSGILSEVIRSEQGGGAGGQASVVQKVYISNLDIGRIVLVINIRNKRQGGEEEEQPESELIRGVLAIVKNSPYISDANLVFAPETQQNLCGPPVALISDILQRYIGQAIKQIFQLLGAVDLFGNPMVLLKHWKSGGRRCAKEFQRGMQLYYAPPAACVAVCRALGICGLACIAGVVDSLGRFFGSWYQCLEFVARNTDVYSVFPQLVAQGGLTDQPSNIAEGLMNGGRGLAFTLGLSLMNFCVKPLKATQMHMSVATGDSSDRFLAGLRGCLLGSLSGLGSLCCGLPSSILLFTSATCVGTLNQIQAVPMLEAVRPRRIFNVGSLRFEEYSYLLSRAREFLPKQVRNNPNNQLLAVIPLALRTTYDSSSKALTSERIQRLAKRMARVSTVTPYCRRAPARRFLAVGCKKVGYVESGRVVWSCMRHQIVQVELIESFNAGDGSACSYFLRIKHFTDFATRAKLEGAVEDASLARRVKDGFAEARRKDRGATPRGGEDSSPTSSEYRDSDTSSSERSFYEEESSTHDSDKFNRFDSCRTSSSTVRGSDYSESRSAAGDSFDEFAGRATRARRERRTPRRDSSLSRKPVGRRSESGSHAWEDFRTFAQQGGSASLASRFARAGESKRDSAGELASSNSGKFYSVVRLWDGSFASTASSQVRAAGDQSASRRDGDSFKSADSKEPVSPGKKRLRWDVQRVRPVSPQEKRSGSPRRGGPDASGDGTRPSGRRQGLFSSRDTHTRRGTSSLAAIGEEREGPESVRRRLRRGRRGERRRRREGEKEEEVEVADRESSDGSLSADTESYGDGTPSQSLSSGDSDRPRRSTARSSGAGKRSLRASMSLSSEAASSVFGGSRSFSQKSRDASSRSLLVEERDREALQLPALADRATKAERVPFLPRLPFSVGRKADSEASRVFFRQRVVQVANYEMAHLGFSVLTYFLDSCVAPGTADSTMSLLV

SEQ ID NO: 909 - protein, 440 aa, Neospora caninum
MALDTPATSLAARDPLDLSTSRDAALAARSTVRKVKSPNLVVLGGANRDVNLRVRALPLAGETVAAEKAVIYHGGKGANQAVQAALLMRRDCGDPAVNDEASKKKHLTQTGGKVALICKLGDDDTGEAYRRYLEGVGIDMTGVLTAQGEPTGCAYVTVAEDAENTIVFDPGANACLTAEDIRNPRITELIQNAKIFVCENGIRPDVVVTALKLAKSSPEKVLTVFTPAPVASVPLEAFAYADYVVVNENEARQMYNLAPVTKTQDSAGNVFEERESSDDEWPSLGAGGASASVFPSPAALRAKLIQLGQKATTVQGPESGAGSESGEQTRVSGERIRAECNVIVTQGKDGCTVIRQKESGHRRVSIQHLEQKRRVPPEQVVDTVGAGDAFCGALAYFLGEEELSVNEAIEKAGIVASFSVQKRGANESYAGRETLRGTVF

SEQ ID NO: 910 - protein, 1221 aa, Neospora caninum
MPPVPSPASQNPMGQPNAVHEALKALQSPDNAVRSASEAALAGVPLPQLLPALAQSVREDGPSPADQHLAAILLRRCLQSRWGEVEGTLDAAEVDALLQRTLEALLQAVLESADGMVKKSAADAAAEVWRRTQTRSLEDAPCAVVARWLAEPELGQLATATALFRLFDRLCEDEDMAARLAQTHGVNVARKVALTLQAGRDGGKEIEGCVAASLEVLVTCVSSLPSGSPIRASLSDLAPPLLSVLLANPSPALFVSAQQLAEALPQFFAGHHARLLELVVHIVGNREGAHDADDSDDVKPVALRLAVSAIISAPKWARKNLSIVKPLLEVLAECCGRVTADEETWSLKDREEDEEDDKLSQEALALATRVAERLNNNAVLEMLLHICTSFLASGDSHRQLAALALLAALLEEEHSSLSVVAHSDEIVSVCLLRLQSPQARLRWAALNCLCCLLQREERDGEVTEREKNLLGNLLGSLQTETNNRCRRKGLQAVAEFFSNFAGSEEDDGGKAMDAAVYGQVGAQLDAPRLRDDGAASSAETGKGEGKTEMKKRSGSDGKQRPVGGQKLAPYIDTALQNAVVPLCDSSDAQTQELALAVGSVLAQVSGQHFQRFFSFFMGAVRRLLSVDFASFLQTHPHGCSLLETVVEFAGALAAAVGMEVFAPDAPWLLERLVEIQNVCSQGTADASLQATAMEAVGVVAKVMGGAAVRFLPAISPIVLAKVRQHVECNFAEAIAAGGEAGAKISEEGRISKVNITDKSGRQTVISINTAAVEEKCAALQLLGTLATSVAGQVAPATAAEWAAAVTAESRAQFALIRKEAFQALPAIVNCLSVSDAAQFVRLSREALALVVEALKENNARHLSDFVLPAATRLVQNLSTEKERKEACRGLAALGERQDAGDGLAAAETVFTAEERRAFLAQIFEAMGRFVIPILTEEFEILASKEGEDDEWENVDEDEEEKAEAAAEAYDAVMQTAGALFKLYGAECLPAFDAHLKMPFGALLAHEQANPGGKVSALCIFADAINYAGAEAGKMYGEVVLPAALLTVCPPSEALVEDDVFAISAAAYGIGALAMHSRETFLSRREGAVEALTRALQSPVLQTDACRSAADCAACALLKIALLYTREVGEQSATIFTELLKRWFPLKDDTQEIDASIELLTNMVTENHILLQAASAKDECQQVLRALLADKAKEAETAKDEDKKLLATWKKARLQKALELIR

SEQ ID NO: 911 - protein, 886 aa, Neospora caninum
MEIPAPSTPSSLTRAAGLVSAPTMPLKAALSNSFSEATSPTKKTTSGSTGASPVHGSGRGMYVVNRRGEEEPVSFDQILKRIEKLSFGLHPLVDPARVAQAVINGMYAGIRTSELDDLAAQTSAYMAASHPDFSKLAARIAIDNLHKNTTDNFLTVIEQLHGYVDKLGREAKLVSTEVYEFVKANEKALNEALNYSRDFEYDYFGFKTLERSYLLKIHDRIVERPQHMLMRVACGIHCGNVERAVETYELMSQKFFTHATPTLFNAGTPRPQMSSCFLLTMQEDSIDGIFSTLKQCALISKTAGGLGLAVTDIRATNSYIRGTNGYSNGLLPMLRVFNDAARYVDQGGGKRKGSLAIYLEPWHFDVFDFLDIKKNHGKEERRARDLFCALWIPDLFMERVNDNAGWTLMCPNECPGLTEVWGEEFKELYERYEREGRGRKTIPAQHLWFAILQAQIETGTPYMLYKDACNRKSNQKNLGTIKCSNLCTEVVEYTSKDEVAVCNLASVSLPKFVDRETRTFDYEHLKKIVKVMTRNLNRVIDRNYYPVPEAKNSNLRHRPVGLGVQGLADAFMLLRYPFDSPEARLLNRNIFECIYYAALEASCELAAEEGPYATYEGSPMSQGILQFDMWGVTPSSGLCDWSALREKIKKHGVRNSLLVSPMPTASTSQILGNNEAFEPYTSNIYYRRVLSGEFFVVNPHLLRDLLERDLWSEDVKQQLIAHNGCVLNMDVIPDDLKALYKTVWEIKQRVVLDLAIDRSPYIDQSHSLNIHMVNPTYAKLSTMHFYGWRGGLKTGLYYLRTQAAADAIKFTVDSQLAMSAKAKLSGSTFSGVLTTTTSSAADEETKRQDVGSADPVETARTEASGPVCRWRPKGASPDEPCEMCSG

SEQ ID NO: 912 - protein, 802 aa, Neospora caninum
MAPQHPVASPASVETGEKPAASLDAVMTDAAVAPALEAENNAGKTPLAAQAFCCSGLDFGTQNCVLASADLSAPLAIDVEGNALSNRSTPSTEAFDGKLRLVGEEAEARATSNLKNTICHLPLWVAVRDEASLEKLKNRLQFASFPEVSFDAPRGEPTFEVTFDGEATQIPLTVVVAHYLKTVVSFAGTSRGRAVESRALAVALPSAFETADVRLVRDACDLAGLSRVVVDEKSDASGPLLLTRTDALLNCWGCKHLPQVYAELPAGVCTPENGPDGSETEAKYIALVDVGFAETSVQIAELRPRDEKEAEQEKGKVQNKIAMKRLAVVVDNALGTVDAINALAKHVVEVVKTKHGEDVVPHSKRALRLFASCQRAVKDLSGLPDTTLALEGFLQDEGDLVLPVSRDLFERLCAPLKARLESLVASAFVSAGVAPLSISGADVVGGGSRIPWVAETLSAALAQGQDAPSRLRRTLDGSSSVAVGACFAASGHRYVQPFALTDDRLAEPGLEALATRLAATEAKELARCAVRNAMEAYLFQMQGALSGPHANLFRDKEEISGILRTNEDWLLDHPDADQEAFEAKFESLKQMLQEKCANYFDAVEKERQQKERELEDAARLAASNAQEDLDVKLPNSQCIKRAKKNKDEGNELFKDGNTEMAVQRYIKALQYTAKLFDLSPQDAAEADALKLACNLNLAQAYIKLASGDLKAPLSTAQETFLKKAVGCCDAALETDPSSLKAAYRRALANEKLRDFDAALEDVKKGLAISPTDTDLLKLKDRLERQVKLQKEKAKKMYAKMFS

SEQ ID NO: 913 - protein, 975 aa, Neospora caninum
MAAAPGQAGEGDCASLHLMQQLLVSTLDHRQAIREQAELQLVGARDGDFSLFLVSLARVIDAPLATADSHQVQEQLLSKQIAAVTFKNCISAKDVVLDNAAAERWRAVAEEAKQAMRLQLLAAIKTEHIQVANAVCQVLSKIGRVELPGDGFPELLPFLLTLVTEATMTPEASAQADGVSAHRKVYGRNALTCLAYLCEEHSDIVEETGEDPADVLSEAHCNNILTAVVQGMKDEDVQLKVAALKALYHALIFSKKNFENQTEREYIIQVVLENTKVAHQAVQVSAFECLVKIAEEYYSLLEPYMSGIGPLSWEALKSGDDSVCIAAMELWNTIADVEIDIQQQEEDAACLGADAPEGAGVPRNSQIIKQALPFLLPILLNTLTQQESEEADAADSWTAAMAAGTCLGLCAQVVKNDILPPVIQFVSENFSSPDWTRREAAVLAFGSIMEGPDTEALKPLVEESFTSLVNVLQDSSVAVRDTAAWTLGRIAQFHTPVVMQKLVNADGTVVAENNSLLAAIVHRLLDQPRVAVNVCWLLHELADHMTAGDGEKLVSTPLDPLFQKLCDALIQVSERADADERSLRDAAFNCLGALINNAGESCKPSMLKLLDHFVQQLSQSFMFEANEATRQRQGLLCGVIQILCLRLGDQVQPVASQIWACLARIFRGPSPPANAPAGTAAQLSCSASESITNDALLATSALVNAAGPSTAAFAEDVVCIVASGLENSTGSAAGSSGGGAGAAAATSGSSTTDELQTVRICVELVGDVSRALGPAFAPYSGPLLARMYQMLQDPNVERALKPCVMIAVGDAAMTMGGEAFAPYLDSFMAILHQAGNTSYDVGPSNWQVNEEWLWYIHDLREGVLQAYVSIVYSFKEKGMQEQLKLYVNAMLDVVKAVAATSPKMRGVDENVKQAIELVGDLISTYGGDLTLHLQRAPFMEQLLQLAQVLGAVKDAGGEACLQKAQWLRQLMARYS

SEQ ID NO: 914 - protein, 521 aa, Neospora caninum
MTANSGPVNTGGSAPAGDESLANAAAKKREQLAAAASPQMRALLQQAPSEMKQPEQRLQEEKAKHPEAVALLQQIEDALVSKRYHEFTMASFAYVAPLSLGDNSLGSASIEVPSPAPSFSGLDRVEFFFYVVGPLQNKLDEAAFLRLLGAVCEDIDGRDALFFLSYYPLSDGTQSSSGSGQSRGAESSVLSPNASPSASQAPNAALAAALEAEVLYKTCQSYHLSQCQEFSESEEILDELQKKLHDTSVGVGGVAQAAFQRAAATLAKAQDKYAEFYHHAIIFLAYTPTMSIPEKDRVGLAYEIAVAALVAPDIFNFGELMQQALILSTLKTEPEHQWLWLLLEAFHCGSLPQFDAICSDYARQIQATALANHMPALRRKIATAALLRLAFTRSAAGTAAGNPEASGMGEGPAAEAPVGLSAGGAGISAASRSLSFDVIAKSCKVGEDDVERLVMRAMSQKLMRGSIDQVKRQVFVTWVRPSLLLDETGMTYLQDRLLRWIGAAEQLHQQLQNQTTELLGS

SEQ ID NO: 915 - protein, 1734 aa, Neospora caninum
MTRSAVPERPAHPEEAETMHAELRNGYPFNERQQYITKFPSSSFLRCSPPDQVTADTAYTADVSVSEEDHEVIVESFLEFTRAVRGTQLQLLREKFPFGGPTSPSLSAAASVSSVLPSPLAPRPEDREAKRRLLYRIVEGGLQPGVLSQFLHHGVHHPQGVSSRASPKSGKSHRNEALEVTVSTAVSASPSTLSLPPGEGLDGSFLSPSCSLSHAEAAAVIAARVDAASSAGVALPGQLQALVSHLEHRLYRHRREKRQGDESPKAAGLASEEERRRHAPFRASTLQTSEEDFHGEFKDGTDDRVKKTRVLVGGSLLPLVLDGTAVYVQEAWLPRQPADDREAPEQPGNETGGEQREAGEKRQEDGASPGGTGVCSSPRPAQTGEERSATCLGGTEAHLLDVLHEFTYGGSFKVAARSSEERRETHTHKGGEETDAAIEASVVALLEGPREKEPGVRTPEAEPRDTACKLSLYFHFRNSEEMVQALASPEWASFQAALRLLCVSDSLTSRIFHGVVHSGREMTGLHSVAPPVLDLSPRPPEPTPFVPPQEQAAGPRRDTFDWSTQLDGSAVVQEDPRLQDVVDQLQLRFGHLRDVIERVTKKFGSLEAFANGYKVFGFQRVEAEQGRPGGWSYREWLPHASEVYLFGDFNNWNRTSHRLQREPKDAFPFFFEADLGLDPEAAAASASAQEEARQEQKQTDGGVWSLFLPDHADGSWALSHRSRVRVRVVSENGEEFDRVPAWATVAWKGEDSNLFNAVIWKPPREEEYVSRHPAPAAARLSGAPRVYESHVGSSGPGGERLGTYSDFVDLVLPRVKRLGYNTVLLNGVVEHADYASFGFYVSSPFAISSRFGTPEEFRRLVDAAHAFGLRVLITLYHSHVSRNALEGLGNMDGCESTYFLDGDAGTNAEWQEAKLFDYGKTEVLRYLLSNIKFFVDVYNVDGFRFEGVSSMLYTHHGTAWKFDLFDYASYFAVGSLRASSLLYLSLANTLLASLLPAPRRLSLANEWSAFPTLCRRVEKGGLGFDFRHEGGWAQKLRRQLQQLGGHSWRLDELVWAIASKPNTEKVLAAFEDADTTRLCRRPLSVALFSWESLHTHAVGGVAPHVTELAAGLARQGHEVHVFVRATGMEPVSTVHFGVTYHQCTFNLDRDFVKEMGNMCDSFVNKFLEVEAARGEVFDICHSHDWLAARAMVRTKQLGRTSIMTMHSTEFGRCGNNAYGGISKSIRDIEAQACHVADRVICVSGVLKHEVQNQYGIHPEKIKVIYNGIQCERFDGEVDAGEVKAQYGIAAMDPMFLFVGRMVVQKGPDLLLEAIPFVLKFRNDAKFVFVGDGHMMGQLVQRSKHLNVSHAVRFVGQTGGAVLHALFKSCDAVVVPSRNEPFGIVVLEAWSSGKPVVATNSGGPRDFVNPDHTGYLVDPQPGSIAWGCCEILKNFEHSRWMGSRGRVTAAFSFSWDSIATQTAEVYCEQTCRHDLPPNCTNAKKGDKTMALALVGPALHAHMAVFDADPSVASGLALWRVLRLLLFVVADGWLGFMGNEFAHPDEVDLPRPANHFSMAKNFRRWNLADDIRLKFKHCEFFEAFLSHWENIFECQSASHLFVVSCSDKTQVVVLERGDCLVAINLHPTQSYEGFHTGCMYSGPEMRLLFDTDEERFGGFGRLTAKSLHPILPGKDSRPHSVKLYLPSRTAAVYVSSQLFDQTYAAKWDADPVMNFTADEFVAHLATVTAECMQAFS

SEQ ID NO: 916 - protein, 373 aa, Neospora caninum
MAPQRKYYTVGVSNKFSAFADNDSEGGDSSGEEDVILSSPPAPTGETQSTGKQLSGTNAGSGKKANEGVSAHHDSERRPRATTGGRFGREEQSGPGGVNSRHGEFGGRGRGGFRGGRFPRRNLREGNEVENEEEQGVEAFGQRRNFRGGRGRGGFYSRGRGGAQGGYDRHTPAAMGGRDPKKSGGGAHNWGDDERVAAAGEQEAEKVEEKEKREDGEEDEEKKGEEEEAVEEEKKEEVLDLEAYKKMLEGKRQNLPNFIKKSNKKITTDQELEAEGYTLHVKEGREEEEETTSEEEDEHEEPKKKTMNVFEYIHNGGGRVNLFPGRRRGRGAGPSGSREFRGGRGRGRGGSFVKSRDAPDIQDERAFPTLGGR

SEQ ID NO: 917 - protein, 1136 aa, Neospora caninum
MMGPALTSVRFLFFGPRRGLLSFLFILFQWVMNFPSCRVEAVTPFQKSFLVQFEPLLSSSDKAGGNALATFKFDALRQVFKASAGESFEDETVKRTVLLGRQTFDTIMQQTLSRDSDKPSEAKVEYSPGGQSPLPSFAIDAISTMTLGGIQHLELVCTLDRVEGSDDSAIRCEPQPQALPGSLRVGFIFQLVPSTDKVRPSQTSASSPPLCRIVHDSGRSEFPSFLDAAIGLCAAFGYDSQLIVHEGNAALDLLPDLYPEGLPSKGFESIPARYVKPYHSLSFVGIKPVKSTPSKNVKDHSEADFLPNEELDTLSWRGVAVSSCVYENALGRLKEAIRNAVISDGPTEVRDCTLHVGRPDQYTDALTKAAGSACLPGKNFLGCLDAIRTGPYVEEAYVAMRSMRKQIEQLTPTVSPNAMHMLSMLMEPETWRTLHSLIGPQAARLFETPSQTAWYEEGMLKVKQHTARTDAPLVPSSETLISEALRFPLWFLDIFPSSKYWQTLKLGCVLEDLAYLGEMGRVFIRQSPRRLEYANMVSTSRIVNPAVLLQEDVTELRGETSTHDLRQSDDDDTGRESVIESGQIFLPSGKSVRPLQRVYAFEDLKAVSNINPAQSENDDAVRRLWLVSPFFEERGDITVTGVPARDGGTFDLRFLCTKRGRFRISSNLVGWFSNYLCEPEYVPVPDSEYTGQLRQGDKPVNRLIGIEFEDHAPWRCGVSFLGTERQLKETAVRGSDLLKIMTGLCSLLGFKTGWILDSVTDLSTHEKMKITMVLEKRISFYENQGFLLSLNTIKSREHVETCAGSSAADPTGVLSGVCKQPHDILVNPGFEATTFYTLVERTYDTLYNLTFDCNSPSWQNCGKPFPLSVKDPRGEGCAFERHPLFHELKYLNPDKCNTGKRIGECHEFVRKHLKCNRHEKKGCKYLIFLHTQFIYPGGDTGKKLPKVIQDQYEFVGKDIHKEAGPLLFEAIRKSATEELSRVNSLESAAATTEFRDMHEEGTGGDGEQPAALISSVRDMLLESLIFVDWTGTPQFWIRAQYKYDEKTGMMTEDKDKLFCPVAYAWAYITRLHGQLYRHSSDYFQDKLPRTSRPTSDDQQNEALPSSDRMALQDSSGSESDESDTQQGRRPIEQHLF

SEQ ID NO: 918 - protein, 1153 aa, Neospora caninum
MMDDAAQVQQLELLCQAFYGGGSKSEQNEAHQVLLPLASNPANVPRLQIILAKSNNLQALLFATAGLTNLFTKHWSQIPDQLKQDTRHFVLNYLYQRGPDLLHNAPEILGHFVRLLCRVVKLSWLESVSNQKIVEQVNQFLNASTAHWVVGLSIYTELTQEMQPQMGRQMARLRRTAFSFRDTALLDIFKVAVQTLQQFHSGAIRVPNQQEETQLLKQVVQLTHNCLSFDFLGTVPDDATDEQTTVMLPQSWTMLKDESFPKTLFELYELCWTSREGLLAAASIGDAAGAAALDGDGARGGNGNTGMAESGAGRAGAAGFAFYTPPQLRVDCAQLCLSSLVLVAALRRSFFSRDQERADCLSQLILGTSRIIDKNLGLHNDMCYHEFCRLLGKINAANQLSELCTSKAFADWTAKLFQFTMSSLEDWGRLPNSKHYLLGVWAHMVSPLLFFRNTVPRQLDVYIQRITTAFIVSRMQLAEAMASQPDDLDLENPLHNEVLRAEQLDVLTQLGRCRYAETATKVLELFHETRAAAEQKAISRDVFQQKITWLVYIVGALIGGHWTGRVPMAAADDESQGPSHVVNAELAKLVFKLIDETNKFTDTPESLELGYLYFLEQFRKVYIGEHAKQVVNMQSPDRFAAVLGASNDDEVLGLLVTKIGFNLQQRADMEDVIKRTLSLFHELASGMNIVHCTDRSPHLIISGRLLLNNPTANYLLQHHRNEEFKFLHVRGYGKYRTTYYFTLAKLLFLRIGSSGTGRGTAAEQFEAFMTPMSAVFDQLWQRTADGSNIQALADPQCRDPLIGLVRDLRGICMACNTTESYSTMFSWLINHPKQPGKSRIHLFTWAAGIWWEDPEVIIPLLKFTAEFVHNRSQRISFDQASANGILLFKEVSSILVSYGKRILEKQDFRDMYKEKYKALAVALEMFSHALNGNYVNFGVFDVYGDGTLNDSLKLSLSMCLAIPDEDLQAYIRSLKAYYSFLDLATKNFMSQVLELSPPLLAQLIRAVEEGLCSFEPGVAMQCCSIIDNLVTFFYQNLNSPDAEGQAVRVFLESQSQSLKRILQLMFQLVITGEFTSVWSMSRPLLGLILLQEQEFLAIKQQLIEQQSKEKKTKLEGFFGELMADVDSSLENKNKDQFTRNLYQFSSHVRQCLA

SEQ ID NO: 919 - protein, 656 aa, Neospora caninum
MAPHPPRDSGEIHSPLAQRFQDLPHRRGAEAPSPSQTASPPATDSSDAPASPATDSSDAPASPATDSRDAPASPAVCAKPFVSSPFCVSSGAGIDGASTGSWDRDSLQAGDAVVGRRRFAANHFLPLLTELFVALFKAHCFSSLVVRVLQAIEEEIVVDDAFVPYLTTPRSNAAWSTPRCGSADTGESAASAGLRGDARGSFSEPEDETSGESPPRSPPSDPDASLDPLSPVVDAAPARCVRKASAKWPLFCPPTISSFGSLSLHPASGPIAFPHATFEPVPGGGANLRHLWSSGPGSLAGAGLGRLRHEGEMRFFTKLRLVEAFQRVDASARMTKRKVVPPTFHECRAILNLAQILESRSQLRLITMDGDETLYPDGANFTDERIARNIAALLRRGTKVAVVTAAGYGYETSRYQERLGVLFDFLKEEKVSAEAAGNFYVMGGESNYLMQLSPELTLVPVDEALWTSFRPPCHPREAERLLDIAEAALRTLSEDLRLPACILRKERAVGLIRRPVKEEDDESTLGFGTAGGMHRENLEEIVMRVRRTIRDELGPQCMVPWSAFNGGKDVWVDIGNKAEGVAMLQGLFQLVPRECLHVGDQFGASGNDLPARVCSPTAWVASPQETASILHELLLDPERPEALVRGDSNTQGKERE

SEQ ID NO: 920 - protein, 434 aa, Neospora caninum
MELLYDSTPAGLATALVGRYVKPCLLQRQPPVPLSLCFMGTEAKAYLKVNEVRNSDTSRPQSHPPSSHVPSIVKPRTAAQVSQWLSFCCENNFAIRGASLFQNLHSHLATRTFFCGEHLTIADFAVFVSCYAWMASASQKERILYCNLTRWMDYIQHLPGVMNSVDQLPLLNLLPPPQTVSAAPSDAGAASAQAAAKQQAGCGTKQSSKKSAEPQMSGECRSNDAPKKKGEKGAGGNDKKGSGRAKQSTAGSSSNGGAAAADSSRPVEDVTRLRMVVGQVKKVWRHPEADKLYCEEVDIGESGQVRMIASGLVPYMKPEELEGQKVVVLANMKPKNLRGFASHGMLICATSKDHSKCELMRPPPDTPIGEQLTFEGLQGEPDPVMNTKEGKYPFAAVQPHFYTDENRVGMYKTHRFMTKQGPVFCDSIVGGTIS

SEQ ID NO: 921 - protein, 1215 aa, Neospora caninum
MLYTRVFFRAVVRTDFGERVAVVGSSPSLGNWQANRGHELTTNEDVFPSWFSKEPVYLPLKKPVSYKYAILDERGDIVRWEECEGNRELVPTGVEMTVEDDDGLFREQMTNRGDHGVEGDDDVSVAALDKEEVDARNRVLAIQEEEPEFDENDSLIVCALDLPLRVVRVAQAPCEADPRPGDSAKDAAALVPEKRPGASGEYGSVPSFAGVAGAEREKGKTRAAASCGESEQSTGSPRKGGPPVSPETERGFGGGPVRSRRGTFEVRASKSALLPSLYHLRKKTRLPVRFIGWPGIHVEDEREQEELVEFLRAYDCTPIFPDKEEFDRYLTFCHGFLWPLFHNVVILDSKTQVPFDSDLWARYQAVNKLWADTVLRHAHETDMIWVHDYHLLLAPMHITRKVRRANVGFFLHIPFPSSEIFRCLPCREDILRGMLCADLIGFHLFEYARHFLVACKRLLGLEHHFCRGGILSIEYGGRNVSVRIGHVHIQYADIREKIEASPRVLQMSREIRQRYVGKFIFVSVDRCEKLAGLLLKVRAFQTFLMTYSYARGNVVLIQYAYPTIKYAEDTETMAMELQELVEKVNAQFALPDRPDFKHIELHIQSVGWEEKWAVFIAGDCFLDTSIRDGLNLNPFEYICCHQDNVTGVILSEFTGCSRALASAIRVNPWKVEAVADAMDRTINMPMEEQRDRFTRDQDYLSHNSTQKWADENILDLRRARKPDDFVYVSWGLGNTFRVLGMDSNFRFLDTNQVVRGYRTSRHRVFFFDCEGTLAPDRRRITFVPGGENLFAQGRPPSQQVKDCLQALVDDQRNTVVILSGRNRHLLEEWFSSVKGIGLCAEHGFYYRVPGITGDQWHCMSRQTDFTWKQVAIELMLQYVKRTQGSFIENKGSALVFQYRDADPDFGSMQAKDLSNYLGELLFGYPVSVMSGKGYVEVKLRGVNKGHAVEKVLRKLSNLHGDVDFVLCVGDDRSDEDMFAVINTMTEDGYQLCLPEGSGAGSSGLYRHTQSKDRIPRRNSVSSDENRAEGAPGSLEGTMKRVGSMQRSGGLGGTTGLTSASSSTSLCGAAKKTGPHFFTCTVGKKPSNARYYLNDTDDVSDLLDALQQCTEKDGKEQWNSARDSGLAAPVAAAAAAGSLAGNAAVQLRKGDSVASFASLWKTPLGVGGAVRARDRALAHLAGGASSGLFGRPVSAIDARACAGSGGASDAARPTEE

SEQ ID NO: 922 - protein, 2418 aa, Neospora caninum
MGGHAASSSLASPYSLLRGSKTAQSALPSSRSDRTRKFTVPARKRAVNDDSLLDDSVKEEVPSPGTADAGVDESLIDISRNSSATDLPSMNGFSDALAPARILNPRKFARQLVAKVHAAFVGQSRPSEDAQNEQDGVRDELPASFLSIGEQTNRDDYSGTAADDVEGEAEGSETGHMIPDEAVGKSVFLQGEERPERSDEEEDEDLQDTDSSLDDMQSVHEHGVAFVQNTEKAGKEEAESSSEADDAIVGSSEEAGSESKSDAGDKSKSESESKSESESASDAGENSKSDAGDKSKSDAGDKSKSDAGDKSKSDAGDKSKSDAGDKSKSDAGDKSKSDAGEKSKSDAGDKSDADSSKKSSSGKAGVSDNHKSAAKSHSHLVHVTTGNSPEIKAYRATVHPYHNRRRKKEEKEGGSKDDDSKNEDQTKEGGGKSEHHDSAHEPDSITASSSSHTEEGNENEEESGSSLGDREHVTAEESTHSHHGETGGDEARSGADYHGETPDAGDKSEHVHHGETGEIEARPATRHHEHAHDTGADSALGHPGETGEIEARPATRHHEHAHDTGADSALGHPGETGEIEARPATRHHEHAHDTGADSALGHPGETGEIEARPATRHHEHAHDTGADSALGHPGETGEIEARPATRHHEHAHDTGADSALGHPGETGEIEARPATRHHEHAHDTGADSALGHPGETGEIEARPATRHHEHAHDTGADSALGHPGETGEIEATPTASHGDNAEINGGASWTGNEGETGGNDATPTASHGDNAEINGGASWTGNEGETGGNDATPTASHGDNAEINGGASWTGNEGETGGNDATPTASHGDNAEINGGASWTGNEGETGGNDATPTASHGDNAEINGGAAWTGNEGETGGNDATPTAHHDDIALNNGGEPSGGNEGEPRGSDATPTAHHDDDAQNNGGEPSGGNEGGPRGSDATPTAHHDDIAQNNGGEPSGGNEGEPRGSDATPTAHHDDDAQNNGGEPSGGNEGGPRGSDATPTAHHDDIAQNNGGEPSGGNEGGPRGSDATPTAHHDDIALNNGGEPSGGNEGEPRGSDATPTAHHDDIAQNNGGEPSGGNDGEPRGSDATPTAHHDDIAQNNGGEPSGGNDGEPRGSDATPTAHHDDDAQNNGGEPSGGNDGEPRGSDATPTAHHDDIAQNNGGEPSGGNDGEPRGSDATPTAHHDDIAQNNGGESAPANQGDTGRDHTGDADIASGQEPEIEEEYSHPHPVEARPSDATGGHTPPIHEHDTRSESPDAHHGGEEHQAETGNASVHAHDAAEGHREGEHEHASGEKEHEAGEASVHAHDGAEGQHEGGHEHASGEKEHEAGEASVHAHDGAEGQREGEHEHTSGEKDHEAGEASVHAHDGAEGQHDGEHEHASGEKEHEAGEASVHAHDGAEGQHDGEHEHASGEKEHEAGEASVHAHDGAEGQREGEHEHTSGEKDHEAGEASVHAHDGAEGQHDGEHEHASGEKEHEAGEASVHAHDGAEGQHDGEHEHASGEKEHEAGEASVHAHDGAEGQHDGEHEHASGEKDHEAGEASVHAHDGAEGQHEGGHEHASGEKEHEAGEASVHAHDGAEGQHEGGHEHASGEKDHEAGEASVHAHDGAEGQHDGEHEHASGEKDHEAGEASVHAHDGAEGQHDGEHEHASGEKEHEAGEASVHAHDGAEGQHEGGHEHASGEKEHEAGEASVHAHDGAEGQREGEHEHTSGEKDHEAGEASVHAHDGAEGQHDGEHEHASGEKEHEAGEASVHAHDGAEGQHDGEHEHASGEKEHEAGEASVHAHDGAEGQHDGEHEHASGEKDHEAGEASVHAHDGAEGQHEGGHEHASGEKEHEAGEASVHAHDGAEGQHDGEHEHASGEKDHEAGEASVHAHGGAEGQHDGEHEHASGRNDHEPGGASVHALDGAEGLQDGEDEHAPSGKDDEAGGASVHVRHGQAAGNEEPEQSRGDQEYEIGGESASSHTDHENENTGKLLKAPEQGQETGGATASFHAGLGQGNEGESLRSHSEQRKEGTEKGGVEGHPQTEEPQGKKAKKQEEHRKLDVALRQHREAEEKRRHADELLQKHHLGQGGPRGRATVTAHSHMHVQDITQHRQLEEATEMAGKLTHHLQIQNALKLREMFLKRKQVGHLNLLKHLQDLMQAVVSRIYTKMKGVKRALKRMYLHGRFVIKRFLHETDHKVIRPEELPSALMAPADESNVLGKTTNGMVMDCPTDCNPAACDNKPVNPSQCFKYEAVAGGGGFRRCEPFADPLTATCAPGFTRCAMAAPTRGKHYQMFSSPPEHPLPQPLLVQGSNLHACLRLLPVHEKTKCSPETSEMVEAALKDTQAIAQQPPPHVLEQGVLFENIQVPQPGNYKLCMLQYWRPPESKPSDNVFIMGIDEIGTLEVLQQPDADTLKQVQGLHKKTPETD

SEQ ID NO: 923 - protein, 1601 aa, Neospora caninum
MEKTARLWRHALSVGPASPLQFAAVAAAGKAEEGSFDAAFAFLARLLAALSFFPAGVRATCRAQAPPPGVSGRRGRALTVRRVLLFGVAWLLVLVLLSPTAFLPPSFFTLFALFSPFPCREDGLHAEPPTGVCPASRGVATRLDAKEGNMQFGPSARRASSGGVLSDLGRVFVQTRNARLRACAPPTAASGCLACARAPGALNDQRDASSSWPRLAFSFLPRATFTAAIERDKFKLSCTQASFCHRFLHWVDLFAKKLPRASISAPPLYSVDVKSLPAGSAPPSGDSGEEAGKEGPQEEPREDEGGGRGETGQEERGRGSLPTSLGGEKHEGANAREKEKEQVKKEKEGKKKAKKEKKRRGGARAPVTVLKFDVVRGSDGLRLEARLAVFMDGIVRLKMREKLNAQQLQREVEKAQGKTEGNAKEPEDVHANVFRLDERFRRYEGYIADILHLEEDPAEGTDQEAKVTYTWNATVVEFDAQPPMSAGARHGFPSSFQNARPQNRTRDDAGRACHAENVPAEASSPRTPGKPRDDGSRESRPAWKTLEERESSSAFATNLEEDGLPVRVVLQHSPFALRLYIHHKLVQEINEKQLLNWEAFLPVNSKKRTAAEAEGRQQLEERLHKDPGEMVPNALANSTSHVPPEQQEAEVARVAEAASAAGVDLREKLKGLRGIDWNIGEPLGDDLDEEREVINDIVMPLLHAGEIHDAVDLYRQGAMEEAFDRFLDSKPFGPTAIGVDVTFWGTSQVYGLFEHAAPFPLKSYTEPYRMYNLDVFNYELDSPFSMYGSIPFLLAIHTPAAASDGPPSRRGSVSRYSEDSERPTRRGSFGGGPATLEEERRLRSPLVTGFLFLNPTETWVKIKYDQGGEELPETFAGLNEEEEDELDAVLRRQKRARQKRYHSFASRESLDWEAIQQKRWKNKYDPLRTWWTAEGGVFDVLMFLGPTPQDVHRQYHMATGLPAMAPLFALGKHQCRWNYNDQEDVLSVDRGFDEHNIPYDVIWIDIEHTLEKRYFTWDPKTFPSPQKMIEEIAAKGRKVVTIVDPHLKAVPDYYVYREALDKSLLVRNPSGGIFHGHCWSGDSAYADFLDPKTREWWAELFSYDRYKHSTPDLWIWNDMNEPSVFSGPELSMPKDLLHMNGFVEHREIHNMYGHYHHRSTYEGLLRRGQGKQRPFLLTRSTYVGSHRFGFVWTGDNRAEWTHLAASIPMILSASVCGMSAIGADVDGFFADPSEELHIRWQQTGIFYPFYRAHAHMDTKRREPWLFSKTSVDLVREAVLVRYTLFAEYALKGDPVVRPLWWLSPLSSRFLQEQQAFLVGSDLSVHPVLRPMEEDQKDGFEMDIVLPRDDDNVWIDFFSGMPFFPSSSDEDTTVKYGVTMRNIPVFVRGGTILLTKERLKRSSMNMHHSPYTVHIYPSAADAEWVGGGVATGRVYVDDYNSFDYRQGKFVYEGFVYYPEARQEGPVEPGADTSGSARNTWILRSQSLPLQVDDSGEPLTGQLSDFPHREIERIVLWAVASPPTRVVVSREGPPRVEEETKLTEEEVEGSQQEEEVLFSSEKIEAAHHVSQTQRLGGKTFYRVDVKLPRVEVGRNDWHVEFTF

SEQ ID NO: 924 - protein, 1057 aa, Neospora caninum
MATKKNLDGPMAASYQPEDVEKDWYAWWEHENFFSPTTLSLHQRQVSGSSPAPVSAELAATTKKENKFVMVIPPPNVTGSLHIGHTLTVAIEDSLARWHRMNGKIVLWIPGADHAGIATQSVVERALLKQGGPSRHELGREAFLQKVWDWKNQYGGAICNQLRRVGSSVSWPHFSFTLDEKLSRAVVEAFVRMYDAGLIYREERLVSWSPYLKTAISDIEVDVEEIDKPKKITIPGFEYPVEVGYLWHFAYEVEGGGRLEVATTRIETMLGDVAVAVNPNDERYTNLVGRRLIHPFFPHRDMRVVADEHVVATFGTGAVKITPAHDKNDYAIAKRHNLQCISVFTLDGKISQEGGPFAGQHRFECRFKIQQALKDLGLLGEKVPNTHAMQLPRCSRSGDIIEYMLIPQWWCACTDMAARAVKAVRNGDLKIVPAFHEDVWYHWLENIKDWCISRQLWWGHRIPAYRVTKPAQQEETWIVGRTHEEALERAAAKLGIDGSQITLVQDEDVLDTWFSSGLFPFSVFGWPDLTQDMQAFFPTTLLETGHDILFFWVARMVMMSLQLTDKLPFDTVFLHAMVRDAHGQKMSKSKGNVIDPLEVISGISLAELQAKLHTGNLPEKEIKRAEEVLKKEFPKGIEACGCDALRLGLLAYTRQGRNVNLDLNRVVGYRHFCNKLWNATKFAMDKFESAPQLLQRRESAEAAAVNGNEPKAAFRPGGIFMGSVGIGKGSQELTGRTGVKYDQLEWVDRWILHRLSVTCTEVKKAFHEYAFSEVVTAIFNFFLYDFCDYYLELSKQRLTVRSDAEKQTTRDATRFSSSPYIRSLCALEVLHVCLDRGLRLLHPLCPFITEELFQRLPAHETKPTSICIADYPQPVMQWTDYKLDDEMELFKNVVSHFRSLIAALDIPPKIKPVGYVMVTDAAPGKEMEHASSSLLSFFTARVEDLAAIAKMSKISVRAPEEGAPDCCVSDVVSGSVSIFLSVEDGVNLAQTLEKMNKKKINLEKMIQGYEKKEAMPAYEEKVPADVREQNSVRKGELQAELMMLLQAIDNMKQLSGQ

SEQ ID NO: 925 - protein, 570 aa, Neospora caninum
MCGILAILMSHLGPDRLRQLALERSRLLRHRGPDSNGVHVQTYPDSLCSAVAHERLAIVDPATGKQPLCDASGTVVCVANGEIYNHVELTQAMLPPEEVAQWKTASDCQPLPSLFKFHGASICDKLDGIFSFVIINGSTGEFIAARDPLGVCSLYVGYASDGSIWFASELKALTKDCEQVTVFPPGHFYLSTINEGKGGFQRYYSPSWWGLEKPLPTYRCDLGHLREALEAAVRKRLMCDVPFGLMLSGGVDSSIIAAIAAKEFQKMSATEKGSHIWTNQIHAFSIGLKGAPDMKFAKKVADVLGTVHHQFTFEVEEGLDALDDVIYMIETYDITTVRAAVPMYLLCRTIKSLGVKVVLTGEGADEVFGGYLYFHSAPNKEALHRELQTKLSLVHYYDCLRANKASMAWGVEARVPFLDRGFLDFAMSIDPEDKMCTNGRMEKQILRDAFKGYLPDEVLYRQKEQFSDGVGYEWIDHLKSYAERRVTDTMMRNAKLLFPTNTPVTKEGYLYRMIFAKHFNKGSAARTVHTGPSIACSTAAAIQWNAKFQVNADQSGRAVEVHQFHHGRRE

SEQ ID NO: 926 - protein, 1054 aa, Neospora caninum
MSVGAPAGAAAGAPGALQALAAQLPLAALLEETLAANPAAIRCAEEELQRRSGTEAFAKDLLLLLVGADASPAAKQAGAIYFKNYIRRLWDVDPQQGGISEANRVLVKEHLLCLLLAPSTEKRVQMQLADALARIAETDLPLDWPTLLPELSQKHLVPTVASLQQSPSAAEQKALLQQQVAALEILHAVLKKYRSALRSDDVLLELQQVLPATQEPLLQVFGTALKLLEVAIAESGAGDHSAGAAVNGSKAVTNCPELLEVLLLASKVFFSLNTVDLPEFFEDHLRDFIGGFVVLLRLGLAPQQIDPSADADEDIPGLLEKVATQVCINLKLYADKYQEEFQPFVAVCTHAVWENMQKITSKQRYDFLAAAAMDFLSSAASTAWQAPEGAPEGTSGDPFADANLLKEICEKIIVPNVQLSDYDIELIEDSPLEFTRRDLDGGEHHATRRSSALELVKSLSKLHDEAITTLLLQIVNVLSAQASSLGGGETLRGERLVDASTFLVMAVGIRGSTRFRGVQAVNARVDVEAFFKASLLEELKKPDINKHVIVRLAAIKVIAAFRNKFDVQLLHGVLPLLVAHLASSQVIVHTYAAYALERLLNTKQNGKFKIDKASAAPLLKQATEILLRLLETTRSRASTDGLFENEFIMSCLLRIFIFLKEDAMSTAMPALSVVLACIQAVAAKLSNPSFSHYLFECLATLVKIVSASTEHRAQMEAQVIPVLSVLIQQTLHDFIPYCFQVLGLLLETAEDRNAATSQLYVELYRHLLQPSVWAASQGNVPALIRLIGSYCRRHVLFTDLIKDNMQTLLERFQYCLYHKKLMSASFDLLNTVFKLLPFPFYAQYFNMILTVLLKRVHELNKRQGVCRDVCLSLMVFQCKSEDPSSLVNALETIQPNLSQQVLSFIVLPAVAASPTSPLRVKKVLILGLARMATCPAVTANKPLLSATLEALAMLISKKEEEERSVQRTQAATKELALEEEDDGPGLGGAGTAAEFDVTYARLAAADVAQSKDLVEEVTDVQGSVQRCLTPLRGDIEELAKRGANVKPLLPFVCL

SEQ ID NO: 927 - protein, 619 aa, Neospora caninum
MAGGAETLDFLSGKHAHADGKTKYIVVTGGTMSGLGKGTTISSLGVTLKALGVHVTAIKIDPYLNVDAGTMSPYEHGEVYVLEDGGEVDLDLGNYERFLDVTLTRDHNLTSGKVYQKVIQEERKGAYLGKTVQVVPQVTDAIQAWIARVAEQPVDGHYEAPQICLIEVGGTVGDIESAVYLEALQQFSRRVGRENFCLCHVSYVPCIGGEQKTKPTQHGVKELRMAGLAPDMIFCRCETMLSEATRSKIALFTQVLPEHVISVHDVANTYRVPLVLDSQNVAQAICKRLKLDPTAPASPVAARPGAPLYKTPISMKKWRLMADRLTSPTESVKIGIVGKYTGLADSYLSVVKALQHGAMEANVRLELVWIESSDLEAPEDASPNGATGAGNSAARYEAAWAALKSVSGVVCPGGFGDRGILGKALSARYCRESGVPYLGICLGMQTAVIDFARSVLKLADANSEEFDKACKHHVVVSMPEHSTEHGHEVGGTMRLGKRATILRDSGSLAARLYDGRAVIDERHRHRYEVNPSVVGSMEAKGFMFVGQDERGQRMEVAELRDHTFFFCVQYHPEFQSRPLKPSPPFLGLVLAAAGKLQARFDKYGGFLRSGAVYEEVDRA

SEQ ID NO: 928 - protein, 147 aa, Neospora caninum
MALKRINKELNDLSKDPPTNCSAGPVGDDMFHWQATIMGPEDSPYSGGVFFLNIHFPSDYPFKPPKVNFTTKIYHPNINSQGAICLDILKDQWSPALTISKVLLSISSLLTDPNPDDPLVPEIAHLYKSDRMRYDQTAREWSQKYAQ

SEQ ID NO: 929 - protein, 647 aa, Neospora caninum
MSGVAERKFVNGALEAAVKFWCSVDRREETQNETREMLKNLSEDELAKLFLARLEFGTAGLRGRMGAGFSRMNDVTIQQTTQGYCAFLMDLFGEDGKDRGVVIGFDARHNSRRFAQLTAAVFLSKGVRVRLFGDIVHTPMVPYTVVSANCIAGIMITASHNPKADNGYKVYAANGAQIIPPMDSEISAFINSNLDFWSDVDDFFDNKTGRLTEKAAKSSLLEDPLNTFVDAYIKDIAADLCVPKREAGSVKFMYTAMHGVGEPMVKKMIAAFGFKDNLLTGKARLFSELDAQCTPDPEFPTVAFPNPEEHGALDMAFKEADAHGLTLVIANDPDADRFAAAEKCDGRWYQFTGDELGAILGAYAIELREGQGIAKSNMALICSAVSSRMLQKIAKLDLTRWENECFEVSLRLRADVVVGSLQQLLICWEPASRFQDNGCRFAETMTGFKWMENKAIEMEAEGLTPVFVYEEALGYALSQRVRDKDGVSAAAVWMQMATDLYARGQTVMDFLMSLRKRYGYFVTKNSYFICPDPPVIQGLFKDFANGGQYPTHLGPFAIRRIRDVGRSYDSGETCTFPPNCEMLTVYLDNGAVVTLRGSGTEPKLKYYAETSSSNPEQGAAELEKVIAAVVSDFVKPDLHPAIKVTLP

SEQ ID NO: 930 - protein, 316 aa, Neospora caninum
MSRRKIGLIGGGNIGATFALLSAVKELGDVVMFDVVQDLPQGKCLDLYQSTPISGVDIHFEGSNDYSVIKDADVIIVTAGVPRKPGMSRDDLLAINAKIMGQVGDAIKQFCPNAFVICITNPLDVMVYILRERCGLPHHKVCGMAGVLDAARLRTFLSDRLKVSVDDIQALVMGGHGDTMVPLPRFTTVGGIPLPELVKMGMISQQEVDDIVQRTRNGGGEIVSLLKTGSAFFAPAAAGVMMAEAYLKDRKRLLPCAAYLNGEYGVKDMYVGVPCVIGAGGVEKVVELDLTPEEKKMFDHSVESVKALLAAAPKSA

SEQ ID NO: 931 - protein, 285 aa, Neospora caninum
MSSSRGGETSTSSAASSSAGSTRLVDVGCFILRGDGLLIADPLSVGGTLDTAMTAGGGLGAAVRSAGGRTFSEKKSGFAENGAQQRPELSLPQGSLALDYVAPGLWGVLADVERMQPIGGGCSAAPGAGGALSDSSGDDFSLLMDAGSSVNVLFLLNSAHMQMQQAELSVLQGLPWEPFESPRGNRVYVSSGQVGVFTTHSMTDAQEAVSRASPQAAQAQTALWYNRACELTCSEHQVGILDVAGGPVGCVSATGISEEGRYPIYVARSPESEEIWAVKVAFLSS

SEQ ID NO: 932 - protein, 191 aa, Neospora caninum
MELVAKLEDQELLPFVGYCRLFVVDNDGLQRKTKGSRVEAPVHMKVENGKRVFSAYFPPKDPVTMLKIQSDEQEFVYGKLWAGTICKPEENPNTNRLLCVIQGQNCKRLSEEVDASPESTCKCKAFMPLLPDCYSKPVEARLTTADEKFVTKLVKLEVEIPDELYELWMRYYKTLKKVDHEDKNGDKDEKK

SEQ ID NO: 933 - protein, 557 aa, Neospora caninum
MFANRYGLSGLLKEGHRSFTGIDEVTAKNIDACKALTDLTRTSLGPNSLSKLVVTSLGKRIVTAHTALIVKELEVQHPAAKMLALAAEMQQQEFGGAVNLLLVFAGQLLAQAEYLLKQGLHPNDVVRGYEMAVAKLPAFLEESVCHTLKSLTDEQALAEVLESTVGTKPLCAEGRLHKLVAQAAAMVMPPNNPKDFDVENIRVAKLVGGRLSQSVVLKGMVVTRPPSGSVESKQNCKVMVLGCGLECSTTEAKGTVLVHNAEELKNFTKGEERQMEEIIKGIKDAGVEVIIVHGGAISDVAQHFCNKYDILTLKIQSKFETRRLCRALGATAVVRLGVPTPDELGSCLSISVSEISSKKVTNILTKDSRVCTVVLRGSTPSVLDEAERAIDDAANLVKALTKDPRLVAGAGATEMEMSRKFAAFGATLPGVEQYAVLKFGEAFEMIPRLLAESSGHSGTEVLAALHAAHGQGRVHDGVNTDISVCYPSAKSAVATGAPSSLTVNAVEKKIYDHHMMKQWALRLGADAALTVLRVDQIIMARPAGGPAPRAPGAPDLD

SEQ ID NO: 934 - protein, 1160 aa, Neospora caninum
MATGTAAAAPQSRGRRDKLLSIEEAVQARWARENPYEVDAPAKNAEKKKYFCSFPYPYMNGKLHLGHAFTLCRAEFQARFQRMQGKNILWPLGLHCTGMPILACADKLKREVAQRKAEQESDTHAEKRPDDESAVNGAEQEKREEDAKKKKSKVAAKTGNAKTQWAIMQGMGIPEDEIASFADAEHWLRYFPPLAKRDVTRMGFGIDWRRTFVTTDVNPFYDAFIRWQFNTLMKRGKLKFGMRATILSRREKQACADHDRASGEGVGPQEYTVVKLFVQEEKLRAASVAQHEPLVQLLDELKTATAAKKVSLVAATLRPETMYGQTNCYVLPEGKYGLYLAFTNPKKSLSTAADDEAAQAESEEEFETLMTREEALSACTEIFICSERSALNMAYQGWLPMQAADDPDGLPSPHCLGTVEGVSLIGVPLTAPNATYPTIYALPMLTISMNKGTGVVMSVPSDAPDDYMALQDMKNKPDFFKERFGVLPEWVQPFEPVPIIDIPGLGALPAVTLCKEKKVASQKDTQKLLEIKEEVYKKGFYDGVLLVGPCAGQKVADAKTIVRDEMIERKEAFRYFEPEKSVVARSGDECVVAFMHQWYLDYGEEKWRETVEAYINSDAFQTYSPQVLHQFKHVVGWLREWACSRSYGLGTYLPWTKDSSRPVLIESLSDSTIYMAYYTIAHLLQGNDMYGQEKGTLGIAAEQLTDEVFDYVFAQTEELPAGSSIPVEHLKRMRHEFEYWYPLDLRVSGKDLIFNHLTFSLYSHVAMWPHRPDLWPKAFVCNGHVMVDAQKMSKSVGNFITIQDGIKEFTADAMRVALADAGDTVDDSNFQRETANGSIMRLYLLEQFANEVVNGTLPLRTGPYSDADRLFLNEIVTCTQETKEAYEIFQYREALKKGLYEMHTRRDQYRLLCGEDHMHKDLVITWLKTQCLTLAPIAPHICEHIWSEILKEPVLVVASAWPTFPEHPQDPILHRQFLLLLASVEDFRRTKEKAVQMLSGGKKKAQQPRPADQAVPALTHAVVYVAKEYPPLQQQVLTLLQTAPIHKGEDGTWCAGKEYMDIVKNDEGINALDKNAKKEALAFASFQMRDELKAYGRSALDLRLPFDELHLLQAHQRYLQVSLGLTEIAFLPSDEAHAKDDSPNRKLAKPGKPSIFFYVG

SEQ ID NO: 935 - protein, 238 aa, Neospora caninum
MASSMQTLKNGDEATAFRQAKGKKALLFIQAAHGPSQQMQEVFENFQEDFPAVAFGVVDVTSNKCFAHACSVTEVPSTLFYEDGEFLGRLVGAVPPSVAKALTAWTHADRSTLLNSLREMQPAHQPAPRDTEVPLQERLASLVNSHPVMVFMKGKREAPFCRFSKQLMAIFAEKRLVHFGAFDVFDDEEVREGLKTFSNWPTYPQVYVKGELIGGVDIIRALCEDGSFTEVFPPEAFA

SEQ ID NO: 936 - protein, 1393 aa, Neospora caninum
MLMPPSLVAYYNTHSTRSQLEEGDGEDGDGEDGEGEDGEGEDGDGEDGDGEDGDGEDGEGEDGEGEDGEGEEAAQTREEISGRDGGHQREQEVSPSAFERLRPGVSVSSASSSPRGTESPSRLAAGRRPSALQPELSFLFFPPKTITAAAGSGGEGCVSFRREKSLPKGGPDGAPGGKGGDVLLIVGEQQALATCPKLRGDRDGNAALAATEAEAAGTTPARAGRQRRKTREKASLTRGEKRDAEDLSRRKRGVWQAADGGRGQGAMRQGSAGKHERVSVPPNTLVLDVTDLEEGVRELKERRKEEEDGNDDEDALLDKGLEAMLRMHGKEGDNDGISQEGRGRGTSQKHKDEREENGEEGEGKDGEESDMGEEVDDDEAFAAFARMFGDFLESGGKSGVSSKREKSETRRSAFRLKRKDGGTLTRQDTLFFERDGLAAEDGEDTENRSEEDDAMEAFFASLFDSKAPRPAKKRRMAGTKIHEERRRTPAAGRVRRRLAKAKEDDNIQEEVESAAETPRHEGDTDEEEGEEEEESRGARGEALRRLRIKREDETRHRRAGTGSEEMRRRSPEDTDRGIEKEATGRMRGGEKEAIRGGWEGEEGEEGEKGEEGEDGGEEKNHETPIHGVYLSRAGQQLLLARGGRGGRGNAAFLTNTNRYPTTVERGQEGERRRLLVIPNFADVLVVGFRGSGKTSLLQAASSMASQKMPAASSSVSNFMSLSLPGDRSTTLVCWPSPPDPVAAEASERKRNDGFGEDVFSLREPSNPLHGLLPGPRRAALDPLKGCERGSTVFLLDSPGLPDTVLENRNLSPYPSSPRSSPTFSSPAFSSSASVLGGLAACRLTGMVIDASRPSEIVEGYKRLCRALHSGLPGASLVPRIIVLSKIDLCASRAKLREAVESLRAFTDNRKIFPVSARTGEGIASLVSQTQTLLRSLYVGSHTDTQLPSNRPLSSSSSPRFSPFRLLSPSPRFETTRRSLEPGAAAVENGRRTDLPRNRSSPSSSAPALSPSVSPSLSPPSAGSSPLSVERLLDLYRPLGEHAVRIHAWEDLEEERQRRLRRRKFVGQSLSSSPGVSLRTKETEQTPFASPQNALERTGSDRRPTTLDSGADLHAAALEAEGEEGDDDRDGREGEDYRDDRGGEDDRDGREGDGEESEEEEGEEEDGECRGEELGQGGSDRVPASAFAANGEKERRLRLLLASEGLRRPDEQETKRGASRKKRKKAKAGPRGLVSSKEKLGEPEPDAFPAMPRTPVALEWKWEEELENPKKKKKTGRIFRLSGTLIDTLTRQVKEFDNPAALRLYRQLAARGVIEQLFLEAGAEEGDTLRAGEAELKVLPSYSRRMESLKPLLMNEGLRPLVTEAPEERGDGDHEERRSDEELEAWINTAAEMP

SEQ ID NO: 937 - protein, 381 aa, Neospora caninum
MEGSAKINEELRPALKTLEVPQRLLLGPGPSNSHPEVLRAMALPSLGYLDPAFIQVLQDIQALLRYVWQTTNETTFCISGTGSAAMEACVANIVEKNDVVLVAVCGYFGSRLVDMAERYGADVRVVNKPWGQAFSLEEIREALEKHRPRVFGMVHVETSTGVVQPMEGIGALCREYDSLLLLDTVTSLGGVPVYIDAWGVDLAYSCSQKGLSASPGASPITVGPRALEKIRARRAKVPNWYLDLSLLEKYWGPQRQYHHTASMVCYYGLREALRVIAEEGVSASWKRHQENAAYLHSKLEELGLSMHVEKPWRAPTLTTVRIPDGIDGKALAGKLLAEEHIEIGNGIGDLAGKVWRIGLMGYNSNRESVDKLVAALGKLLG

SEQ ID NO: 938 - protein, 1400 aa, Neospora caninum
MAYPSGKDTEKGSMRRGRSLLVVTNDNQYTLSSAPPEVPEHMPVLAETAPRIHAGGPRPVRRLSFRKASSVTANASEMPCAMRLGSSLGGASQSFALYGSVYGPSQISRDMSSSSSFPVHQREQRARTHLHSADLFDRTSPVQKARQAWTCTLPTALDAETHTLISGPALVDKVKEAFESGPLAQSPEVQKKLEALFPATWGFEYTEVAQGPVDADGGEAAGRQRVVARIGIILSGGPAPGGHNVIAGLHDFVKSRHPDSVVFGFMGGLDGVMNKKYKVLTDELMNQYRNQGGFDMLWSGRGKVNGEEDLKKAKEVCESLELHGLVLVGGDGSNSNAALLAEYFQVHLPSCAVVGVPKTIDGDLKSPLIEASFGFDTAAKTYSELIGNLCTDINSSQTTYHFVRVMGRSASHLVLECAMQTRPNLVFIGEEVDEANLCLADIVKQIADLVVDRLQAGKRYGIILLPEGLIEFIPEMKVLIKELNEVLSANDGKFSPDKLTRARSVWDYLPEMIQDQLMMDREATGYIQVAKIATERLLILLLETELQKRGHDPDKWSFMPHYFGYEGRCAMPSNFDANYCYSLGYTAGVLAEKKKNGYMSIVRNLDQHPSLWTPAGVPFTKMMYVKQDAQGKDFPAIVRSLVSLDGPLFKVFCEVRDEWKLKDLYRVPGPIQFAGVTADEPCYAVMVPSAEDLLAGNDPRANLTCTCGVVVKDLGTYSSLQQQRLLFRPAVPPLCQDMKARARPSKQMFCKDPYTQRQVLMHYPYLSNSSLFFLHDVSHDKYIPPIGFGLRVGLVFISRQSPGVANVLWGLHERLKLVQGKCIAFFGLNGLVDRKFIQIEDRHLELFKNQGGCELIGRSTSHCLGSREMQEKVRQTCEAMNLDGLVIPGSAFAMSEAALLSEYFLAKQCRTSVVGIPATGSNNLSGELIEACIGFDSSTKVYASLIGNVLTDAASMPKYWHFVRLMGRQPSHEVLECALQTHPNFVIIAEEYGAADKTLLHVVQDIADVVCQRAEMGRNFGTVLIPDALLMHLPNMKILLAELRTVLKEADAKGEMKKAQQDLNEVTDMETCPPGSWGRRLTPWSAALFRSFPKFIRRELLQVDMGEIRFERLETEELLAQMVKEELEYRKSVGRYCGKFQAVTHFFGYQGRSSMPSQFDANLAFAYGHLASILVESGVTGHCCSIRGLCGPVKDWRLGSIPFVTLMKLVPTPQDNPAFAARGPGNDAALVNTAKDIRQQRSVMTDLPIIPSAEVNLDGKAYRWMKTAAEQWALEDRFCNPGPIQFTGPAAQFFNRELFEEQAEYYDMVCRVERYTNILKQTCTFGVSDSFLKNAYVSLTGLLMLAFHPDELTAKLPALSTGDFDADGNESGAQPTGGLFARGADELNVSVSRFSKREDF

SEQ ID NO: 939 - protein, 296 aa, Neospora caninum
MAGRSTQAMYDRHITIFSPDGNLYQVEYAMKAVRNCNLTCVAMKGDDSACIVVQKKVAAQQLTQDKHLDSSFVSSLYTLSPTIGSCLVGVFPDCRSIAFRARQEAGEFAYKNGYDMPVYALAKRIADINQVYTQFAYMRLHACTGIMISYDEEAGPSIYKFDPAGFFAGYKASRNLFLRATRYTTSGSPHSTLGLCRSQVLVSYAKERKAGMTEACASGTKEQEATNILEKMVKKRPRTTPKEVIECAISAMQHVLAMDFKASDIEVGVVTKDHPAFRILSEQEVEDHLTSIAERE

SEQ ID NO: 940 - protein, 153 aa, Neospora caninum
MATATKKDGQKIVAYDPENVFKKILEGKIPCHKIFETEHVIAILDAFPAVEGHSLLIPKANVASVFDLDPETAANLYKELPRLCRAVQQATGCEGVNVLQNNGKAAGQVVFHAHVHVVPRYSGDQLFKQFASAKEMIQPPQAESILAKIKAHL

SEQ ID NO: 941 - protein, 598 aa, Neospora caninum
MAPPAGHVETEAPEKRQAAVNGEEPKLSASERRRLRKAEQAAAKKESKQQQEGAAAQADKNGAEKAEDELDPTQYFEKRCQLVEDLKHKGVSAYPHKFQVSLSIPEFIKKYGNLGDGEHLEAEEVQIAGRITRVSASGQKLRFYDIRGDGEKIQVMSNFSYHDEKAGDFSEIHNRFRRGDVIGIRGFPGKSKRGELSIFPREVTLLSPCLHMLPERNTLKDFEVRFRHRYLDLIVNDETRKTFLIRSRIVNFLRHFLEARGFVEVETPMMNVIAGGAAARPFKTHHNDLDMDLYMRIAPELFLKMLIVGGLDRVFEIGKNFRNEGIDMTHNPEFTACEFYWAYADYNDLMDLTEELLSSMVMALHGTYQIQYHPDGPGGEAVTLDFTPPFARLSMVEEIEKKAGVTLPRPLDGDECIAFMKDLLIKNKVELPQPTTSAKLLDALCGEYVECQAQTKPVFITEHPQIMSPLAKWHRSKPELTERFELFVMGKELCNAYTELNDPVKQRECFMDQAKAKAAGDDEAACIDEVFCTALEYGLPPTGGWGLGIDRLTMFLSDHNTIKEVILFPAMRPQPQIGASGKQESDTGVPGEASSPTH

SEQ ID NO: 942 - protein, 387 aa, Neospora caninum
MDNQELLRIPLNSKGSICIPDPPRQPPLLQTRVQLELGEYVVQQAPLLKERGVSVHEISQIFTSIKLAAKVVNKIITKQGSFGLEDGSVKKQATSEDISGLASIANKRFLEALTNREVVAGVATMMQDDIIPMENCKEKNLVALIHPMDGTKQVDVNVSSGTIFSVYKRVTPAGSPVELRDFLQPGKEQVCAGYVLYGSSTIMVITLGSGVHGFTLDPSLGSFLLSHINIRIPENGKIYAINGGKINKFPYGVRAYIDYCRSKAISCRYIGSLVADFHRNMLKGGIYIYPPTFTDPTPSVSMIFQCFPLAFLAEQAGGKASDGFTRILLIQPVSLRDRIAFFCGSTHMVDGAEALMAQYKMRDGGWCFQASKTVDLGTPNAGNKRSV

SEQ ID NO: 943 - protein, 567 aa, Neospora caninum
MNTALSAAVEVDSVTGQTTRGKKGRVAGARTSPATSGDPNPTRTMVTKTISPSDDGTVKPSSAESPQNPDENARVARNAESDASSDEATEGVGPRGGTAAGGRKLSRVGKELQRRTSKVISTINTKFKREYSRGLQMRAVVPSADSLAVSAANSTSTGFFSPPSFQLTQIIHDARCFLPRVGHVCVPCGGDILIFGGVDHESTVTNDFLRYVPGLNVFEPIKAQGDFPSARSYCTIVPWVAPGTSREQLILFGGCDECEQLSTTYKYDPPMRAWTAVRTEHKPPARHGHVALVNDGRVYIHGVMDDMWQFDGTDWTQVQYRCPKGAAPGTPSPETIAMPARTGHTACMWVHSRHKVPCFYFFGGDISGTGSATNDLWIFTLSTCRWNQIVDYAGNAPPPRFKHGSCIFDNHWMLICGGVNHGWFRDSVLGDMYAYDMQANCWFSITVQSVLSSANVELSNLTVIQSTRAVYSFGAREEGTNSAVATCDVFRLSPLVTFVSFSALRHQVEALDEIVKLTGETQSADKGAKLAQMQQAISKLAEEMAAIREENESLKKRLSEVERLVPR

SEQ ID NO: 944 - protein, 716 aa, Neospora caninum
MTHSHIGGGDLPRSLPHWENVSSQPSPAVHTLLIDNHDSYTFNVFQYLATINGVAPTVIRNDEFTSWREAKASVGPVHNIVISPGPGTAENEHDFGVCSEALREAAVPILGICLGHQGLGHVYGGKIQRTPRAVHGRRSAIDFIEGYKLFEGVKRGTLVVRYHSLQVDKDNLPKCLEPTCWTTDEDNVLMGIRHRDLPLHGVQFHPESIGTTAGYKILENFRDMTLAWWADRGSEWPYIAPKNTGKHQVAAFAKTCVTYGVDGDRTELSNDVPAPRLELSDDGKAPEPWEATAVPFAFPCGYAGFFGYELRHVTERYVGPDMQQCSLQKDIGNHSTNVPDAAWIFSDRMIVLNHESNELFLSWLTPSLGQDRQSRKSGETAFSGLCPCDPWAFSCDTDKVAAICQSQQQWAEMTLRAIALASSPVSAEPPLVMRASEKAQLSRGRTPDLESPAQRQAADLSMRPTAVGEERNLPPAKGSPVDDTLCALGSDSRAVDASLNGAASGESSEKHSMALSFHDDVQTYKANIRTILDYIAAGEVYEVCLTTELAGALNPSVVSPLQFYGQLRCRNPSPFAAFLRPERFLMKDVDGWLESKPIKGTRPRGKTPEEDRDLVNDLATNEKDMVENLMIVDLVRNDLGGSMTGAPKERAMEIIERLEERPRGIYSGATGFLSVTGEASLNIVIRTVVFTTPNLAVVFPAPRLESASVSYYGFRT

SEQ ID NO: 945 - protein, 549 aa, Neospora caninum
MPEDAQKREESQQPATAQDQTAAGEAAPSKKAQKKAEKEAAKEAAKAAKREALEAEQRAAQAVLNKKVEDLEQDVFGYLPVIDSRIRTSRVWIPVEDLHNHVGETVWIRGRVQESRGKGSVAFLMLRERQATVQGVLDAKRGNSKDMIKWTTSLPLESVVDVQGEVVKPEVEIQSTSQKGVEVLVKKIFCVSKAAQELPFQLRDAMRPEDGTEGGIRVNMDTRLDNRILDLRTPVNQAIFRIQSETIQLFREFLLTNKFVELHSPKLIGGASEGGASCFTLKYFNRDACLAQSPQLYKQMAMCADFERVFEIGPVFRAENSNTHRHLCEFTGLDLEMTFKEHYSEVLDVLDELFKFIFKGLSERCKKEIDIFHQQYPAEPFTWIEETPRLSFSEGVQMLREAGCANIPDDISEFDLSTEQEKMLGRLVKEKYKTDFYMLLQYPLKVRPFYTMPDPHNKMFSNSYDFFMRNEEIISGAQRVHDADLLTQRCLECGVPPSSIQTYIDSFRLGTAPHGGAGIGLERVVMLFLGAKNIRQVSLFPRDPKRLTP

SEQ ID NO: 946 - protein, 456 aa, Neospora caninum
MDEEYDVVVCGTGLKECILSGLLSTHGKKVLHVDRNAYYGGESASLNLTHLYEKFRPGETPPQTLGFNRDWNVDLIPKFVMACGKLVKVLLTTKVTRYLEWQVIEGTYVYQFQKAGFFSSAKYIHKVPATDTEALTSPLMPLLEKNRCKNFLSFCAQWDLENKETWKGFDPKRHSMKQVYEYFGLQPNTIDFVGHAVALYTSDDYLNQPMGQTMEKIKLYMYSISRYGKSPFIYPLYGLGGLPEGFSRLCAINGGTYMLNKPIEGFVYGDDGKVCGVKSTDGEVARCKMVVCDPSYVNYDPKKVRKSGQVIRCICILGSPIPNTSDASSCQIIIPQRQVNRKNDIYVMLVSSAHGVALKGKYIAIISTTVETADPMKEIAPALDLLGPIEQQFVQVSDVYEAVTDGREDNVFVSDSFDATSHFESATEDVLKIWKNMTGEELDLSVKAEPEDLQEM

SEQ ID NO: 947 - protein, 587 aa, Neospora caninum
MRSPIHKLNDNVNDPVFPDGYGELSKGDSDASWTEDEETEKKGKSAKHKPFFGRAKASKAAAEADTGKSDTAKDSTPVLNKDAPKVEPPKSSETTKAEEKKVEPKKPEDTRGDQAKAKAQSTRATSKEILYGDSAAGILSPPDFFFSSIVHDGKVFQARTEHLVVQLENTIYIWGGREAETVYDDLISFDPPSNTFSTIAVDGSKPSDRRGASLVARVRDDGHGILTLWGGEEKDELTNKAWNFDTATNSWSAMTARSTPSPRKGHSMCADNDALYLFGGVDAKGVKDDGYVLKKDIWTRLKGDKVPPARCFHTGTLVKTEKVNAMIVFGGDLSGGGRPTNDLWRYDLRDEEWRHIDNASGETPVPRFKHASAFYEGRVWICGGQTAGWFTIYAVSDFFAYDVSGNYWFKCDVAAKQLGYHSSFGPLALFPQTKALYIFGGSSSYVLDVRRDVTETALEVKQVREEVEKSADTAKKVMEFVGKLEKNMSATSGKVSDLSRSVGDFQKEISTMVANSSSCMESVEQVRKKLDSIEVKFVAFAQLERRCELIESSITELLRKLDEKADRSSLRKIADHVQISDSEEDSE

SEQ ID NO: 948 - protein, 481 aa, Neospora caninum
MTAETLQLLVALANERQVPAMVKRMFSGEKINETENRAVLHVALRMPEGSQPIIVDGKNVLDEVHAVLRRIHVFSEKVRSGEIRGHTGKKLVNVVSIGIGGSYLGTEFVHLALAAEGHAAEKAHGRQVHFLANVDPVDVWLAERNLDPEETLVVVISKTFTTAETMMNARSVREWYLNHYKGDERALGAHFCAVSTNLEGTSKFGIHSDRVFGFWDWVGGRYSVTSAVGILPLALHYGYDVAKEFLKGAHAMDVHFKTAEMLDNLPMLMALVSVWNSTFCGYSNVAVLPYAQALLRFPAHIQQLTMESNGKRVTMDGKTLNFDVGEVFFGEPGTNGQHSFYQLIHQGRVIPAEFVGFCKSQRPIKLKEEPVSNHDELMSNFFAQPDALAFGKTPEQLRKEGIPENLIPHKTFPGDRPSCMLLFPEISPFHIGQLLALYEHRVAVEGWIWGINSFDQWGVELGKVLAKGVRGILQKRREGKQ

SEQ ID NO: 949 - protein, 860 aa, Neospora caninum
MMSQHHPHASTFNAGAERGPAHGAGAPPRGSAAHSGDLDWDSLGGMRRVTGAPAANSCAPTAGLSLNPPTQETVHAGGAEDLTRGPAAPSPPIMYHHVPASQGMMGANGPHSHANAGPVLHGNVYASPVYNNYYGPAPGSGFVGGVYPGYPGGAAGGHAMHNYPGPGKYGHYNSGMNGSYSGSPASGPGLVGHAPGATGGPGGVSPALHPASPGGERGGKSFVRRGEGRNVNRGRGDANAVFPPPVDGGNAGFANSRNQGAGKRNEGGVYRAGHSRGNTGRRMERGRGEQAGVGAWGSGDEGDNRDAVDEDANAAVTAQNARGLLAPRQGLQSRNASAPTGEERDGFVQASDTSASLLADDGKKRTEQPRVEPRAEQSPPKEARDDGWDDDGFGGGVSMVDINEIRNKHAQLANKAPSAPRAAAPLPSMGEPKTASQPAGKKDEKKENADGGKGVSGPEKKEASRMQLPSFPAVPQSQEGAAVTESKKEEVKKEEAKKEEPAPVAETSGVSALGKPGGGAWRPRSQRQFTREEELDRTVKALLNKLTIEKFDTITEKLARTVEGLKEHKELQLVVNVVMEKAVTEPDWSEMYADLCQVLQWRSVPTEGTDIDNFRKTPFMKALLTKIQAEYEAMPRTLESRLRSLPSGELDPEAVEEMQQLKRTKNRILGVVKLIGELFQRKILGFPIVRDVVVDLVIKNEEPDEHFIECFVQLIATTGYYIDQNPKMKAVLDSWFGRLTELQKKACYSKRLKCIIQDTLDMRKAEWRKKIHKERAKALSDLREQLETEEVLGGSVHAAQYGNIVVVGQRSNLNGAYAGYLKDQQDTFERKIAKLRPATAPTPGGPGAGVSPYGANPVRR

SEQ ID NO: 950 - protein, 716 aa, Neospora caninum
MATTNSMPPTDEAATDKLAEQLRELRVKVTQNAEKVRLLKQANASAEEIAAGVDTLVRLRAQVSELEKQLESTRPLYYQLRSQCENLLKRRFFVVPSYEIYGGVGGLYDFGPPGCALKSAVEQLWRQHFVLAEDMLEVSGPCLTPHIVLKTSGHVDRFTDLMVKDTVTQDCLRADKYLEEKIDERLNAKEGISPEEASRLALLRRQADALSVQEMKAALEEVQAKSPAGNPLSDPFPFNLMFGLKIGPKDESGASEVPHDARSQKGAASSRSAEGRGYLRPETAQGIFVNFRRLLEFNGGRMPFAAAQLGLGFRNEIAPRNGLLRVREFQMGEIEHFVHPDHKDHPKFHMVKDLKLPLFSRENQLTDGKVLRDVTVGEAVAKKIIDNETLGYFLARTYLFLTRCGIADSGLRFRQHLTSEMAHYAKDCWDAEVECSYGWVEVAGHADRSAFDLTSHSKVSKVDLIASRKFDSPQVVEFVKYTPNKGLCGKTFKDRQQALHEAIEEKSDADRLAIEAALASEGKYSLALCSGEVFEISREMMKFEKATKKVSEESFVPAVIEPSFGIGRILHCIMEHAFRSRGIVDQEERCYMAFPAIIAPTKCIILPISSNPSFADLLQRARDGCVARGISAKVDASTASIGKRYARNDEVGTPFAITVDFDSLKDDSVTVRERDSMEQIRVPLADAVDLVARMSQGALDWATVKKTHPLVVVKEN

SEQ ID NO: 951 - protein, 1166 aa, Neospora caninum
MDLEAFVSLLRAVISPDPALRKEAERQIKEGKEKQPAALISLILQTVQTHSDDEVRLQAAVLFRSFFRGVIDSESHVWKHLGETERSQIKQILLHCLDTEKNKLVRNNICDTISDLASDLIPIDQWDDLGQVLLAMIQSGVPVKQQTGLKILSEIAPVLTEQLAAAAPIVCKIICACMAAGQDVNTRVEAFALLVSVVEDVNKRVYKKFLPDAKTRAAPECPPVQLLIIDTLEATLRAGAEDDYALAERMMVLVIQLCEAEQGGGVALMRPHLAQFCDYLLAISLIGQGQQQAAEAAAAAGTAAAAAAQAAAASLGASGAEPKGPCVAATACAAKTSDEETPEGLQSCRKYAVEAMICCVEQKNQVMLKVPNFLNRLLEALLMCMLDIRDSSYAKWLEEGDEEDEQRFFDVGEEGLDRLCRAYSSDEDIAVGSRTQAASLLLPALFNYITTFLQRPEWEYRFVALMAISQTVEYVQEDQEEELDYIAKTLMRYLGDPDFRVRFAAAQAIGQMSLDQTPYVQEQFASEMLPLLIARMDDEVPRVQGHACAAFVNFSEEVEKAEMLKVAGQVMEKLLTKIRPGTPKTVREHAVTCIAVVAGVLEESFVPYYSAVVPSLLDVITNSTALELRSLRGKAIECISIVGLSVSREQFAEDGKVAMEAMLQIAESTATCEDSKTSSCCSQATQHRCMDEEGDAVREYLTEALGRMCRAMGADFLVYLPRILPRLLDVLTVKPKEMKAEEAEDDEDMTYVILDSNTSLGLKTSLLEEQSRALDLLCTITTVLQDPLTAASLSSAAFSASSFLQPVAEAVFPLLTHVLSEDIKQKALETMASLIGTCKQLVLQYVQRAVQARSEGQAPAEEEARRSGASVKEMLRAMTLRTCGEVFKSLQDEDGDVDSMVAEASGLNDCLSKAGAEVFTDEEVSQQALNVFSALEKSFERRIDISARKNRQDEEVDEDDMLRLEEEDQQEQTLRSSLLEIVGTLMATHPKEFLRSKASEAAAAFVQQFLRDDAADEDKSVALYVCDDILQHLKAATDNTAAALGDLLRHYGGSMSAEEQQVLLASWLENLPLKQDETEGLRMHKFLMEAVLQNNAVVLGQNASNLPRLLQILCAVYRTDFSDSDLNEEIKKLFAQINTTSQPAPLAALCQSFTAKEQKKLQKILK

SEQ ID NO: 952 - protein, 377 aa, Neospora caninum
MPNSKKRTGSTLDGGASPAGKHQKKDTNSAAAQNALEALRLLSVVVADTGDFETLKKYVPQDATTNPSLLLKAASMPQYAHLMDKSIEAAKKVHGKVALDDAFVEEVVDQLFVFFGVEILKIVPGVVSTEVSAALSFDVDASVAKARKLIQMYKEHGIEQDRVLIKLATTWEGCEAAKILEKENIHCNMTLLFSFAQAVAAAEAKATLISPFVGRILDYYKKAHPEKVAEYVGASDPGVQSVKRIYNYYKKHNYKTTVMAASFRNIGEIIALAGCDKVTVAPALLEELSGSDLPVPRVLGAGTENAEEVASPPRGSQENGVTKDEADAEKLEMDEKTFRWMLNEDAMATEKLAEGIRSFNRDLLSLKDMIREKLRKM

SEQ ID NO: 953 - protein, 414 aa, Neospora caninum
MAIRSSRGPASGVVYWEKQGADRMCALHCINSLLQGPVYDETEMSKIGYEFDRRERQLMAEGMDASAYKEFFDEESGNVAHDGYFNVSVLMECLRKQHIQCLSTSKPEVCHVLADPSREEGFIFNLNEHWFTIRKVEGIWYNLDSLKPSPVAVSAEQLKNLLTSLSIQGYVSFVARRDVGSLPAPEPQQVRMNQFYLTKRDIEELQRQAKEKEAQDAKAAAAHGDDGESKRSFLAWAPRGRREEHSWPSEGGYRLDAPGNASEEVSRSGSPEASSVGAGLEGVDDDPELREALRLSLETYKQEMQAPPEEPPADAQNICAVVVRLRNGEKVMRRFYQADTMERVFQWAEYEASQRDSTTLGSCVLVQTVPKRKFCKLGGQICLCEGDTEGIPIKDRELHELGFQRREQLMMMHL

SEQ ID NO: 954 - protein, 1583 aa, Neospora caninum
MTASAAPDRMQGVQRAGKSRFRQTNASGSASSSSASRGVHSAPNGKSGSAQTHAQSTNRNSAFGSGHGHEAGPALSAHQQRLQQNALLSGRHHLTVGADENSITDLSPRSQKWIEDVHPLLEFFNYSKRDVYALVQRAEYDQDRVQQAVAEIVEEKKGHEQGSWEVVLTKQQKHQLRAAQTETQTPTGRGEGRNRRGAERSGRNANGNASRYRGASGTAGTNLASDSGADARAGRRTEGRASASPGQRRRRDSRAEAGGARRGGAGAPNASGKFSTDRRRGRGDQAAATSPGVERDWEVEALESQWGAGPDGLVPPKTSVRSGESEGTSAGSPVARQSVPAAQGKDEAAASSSSEARTAAAPAPSTRSWAARLVQKKEPAATEAKAASPQGPAHLGDVEGTRGSDSRKREPSPIAAPETKSPRATPVRDRSPQPAKDAKREALPIPSAHVETSEAEATAQSAQAGEASPVATPAATPVLRVSPAPEEPTSEKAGEQSRSPRAGDEPAKREDVASRGVGAVASSPVVIMPQNRHAAGAGGVFLSDGALASSSTRVQSPGAIGRGPHGGMVVVGGARPVMSPQSPRAGQVRAGAETSPLGYGGRGEAFEAGRAAGQDALTSRDGGASVEENLLTFGTVELRFCTANRSVAASVSSAEKPKAGGAAFTQEPSPKLAYPAEEPGSGAPSLLASSAAGGALLPASLRADGLGAPAASAEANPAGQAAEPSEGAAGARPAGVASPRQQSPFPSASGSREQASTFPSVSSRFGPSGGAPLEAQGMHAPGAGTRDSERSQRQNEEALPSGGARANEPVAAGHSSFARGQGASFASQHNQSQGAFQGGRGSSSYAMGGAQSHPPSSSRGNYQMGPDESGPEAGRGASADAQHSHRNLSGVQPAHQPLLVSGDNAEFQSSHGASDAGALDAYYHYVGGRDFVGGSAKLEGTASLAAGAGAAGASSASGRYHQSGEQAQGSSSLEGEGASQMPSFSSPSNLYPNASLFANSAPSGPSETSAPGAPHQAVGSGRDARGSAGERRKKQSSYHLSAQNSQHASGFYGSGAGNAGLHGQTASWSGSAHPHGGAGLGGLGSGLGGSGVNAQNAMGSSGFNDLIGNAGSGSHSLNRNHAYEYNAVGNLPAGSSLATAKPPPPPPPAASASGSLSETNRLLGLGQPGNANSQSGNASGFSSYSSHVHQRESGQSSNARSYGQHSGAKGSALHMGTSSGATAASSSSHAAHSEAAGSSHASSSAFTPPPGLAPAVSATAQSTGGSQQPSASSPPTGSNSGPPSSYTYQGYHHTGMAYPHYNNMYYNHHGNMMPHHFGVMAGHHAATSNTSASSAMGNPTSGNVSSDAVPYSASSQPSGSASSLSSSSLNATSNALDLETSNASESHGSGPSSSGFAQQHFHGSEAGAGAFSGGGYGHAQSSNKTLGSAPSSNTSGSYMSYYNGSSSGFSSSLARNAQSNYGQNQQGGSSNSGGFNSRNNENANLGVLASSNQSGGGYGKNSGGYGSKQYHGHSSYYPRGNASSEQAAQAAAAAGYYGGYSYGQYAHPPGLGNTFYQSNFANQSGSSQGRPNYGGYGNANMWS

SEQ ID NO: 955 - protein, 333 aa, Neospora caninum
MEELELERSLKELLWTPSLRWIFVGGKGGVGKTTTSCAVAAQLAKTRESVLIISTDPAHNISDAFTQKFSNSPSLVNGFNNLYAMEIDSSYQETFDFKLSNLPSGEGGTSFSLTSLLPEMLQAVPGIDEALSFAELMQSVQSMKYSVIVFDTAPTGHTLRLLAFPDLLERGLKKISTFKDKIQSALQMLNAVSGQQIQEQDFAAKIENLKAVTTSVREAFQDPAHTTFVCVCIPEFLSVYETERLVQELAKQKIDCSNIVVNQVLFPVGGVQDEDGRPPASLAYASDLGPPVPLEQLLAPPAPQGEAETVHDENARLRRFIHRIQIRTRSVGV

SEQ ID NO: 956 - protein, 3415 aa, Neospora caninum
MSAGGSEEAHSGDGPPADAPLGGDSVSLADALHSSSLAARGGSFPGELASSLDVLSAVLSTAAEAVSEADQGIRDPSSVNLVASAVIMNIPTTPDITKAASAQLRHILSVVRSAIVAEVRAVADSGNAALPLLTSFCQAAQHAFKRMRAAPAAVAEAGVARYLSVICEVIQNLTALEAKVLCEHQACTSVFCNALVLLSRSLAPAARAASAAGLEATDSLTLLERQLCQPVEAGSNAPLLRGTAVHLLERLCDMSPSLRELLLQQATKGLASPLPEGDCGPYVPVYILGRYMRKILTSGASRGKAEKGRHSPGSHQAPDDEKKLLAAKKSDALDMRQALLKLYIQAVVESRQPVGGVLCAAFRPLLSLVQEGDWSLVLPPLKRGLKRSPNAALAAAVCLVSSSSVECSSCFIPLLEEGLLDILKSSSVAVSETSRLQATLQLIGLLAQRCSDTAVLCEVIVKRLYAPLKKGSLTKAGERIAFLGALSECLISSHLRRRFPAEMQEEWFSDFASGQASFFLASLQNEVNEEVKVAVCRVLGLLLSVSLPLVSDPADASLKPFVSALAKLLALPGTGGASDKASKSTPPSPRLASASLEALSVAAASQRNRVAGLGVLREAGVPTAAILPLATTKAGLRPQCLQAWVLISLLEELRTNEEGSAGLVAGVGGERDDACLVPKSAAQLIIDGDSYLNNLVAVEKAQVPEELRSQLRFVTLLCARRPLVLSTVPYGFPRQESGEPVLLGGVTALSLGFLDLFDRSHFPFPPLSSGASGPETAASGAASCPLVSGFHFGLVRLLMTAMQRRFHGQCSLKGTSEEETATPASRAGPSSDSSAFAASLSFFLSRFQQAARPVPDLVDLLLLAFYFQLARFSSAPVASPTSAPAGAAKAQGVQTRKGASSAAPPGGSAGAKASSSSPAALSTSPPCPSALRATLGFLLTLRYPQTSTSASASLSGASRLAEGGSVPPSPQFNALLLLCLMHPLLQSGAQSPGHLLRAFFSRMQALCGVAEGAGSSRDKKAGAGEAKKPPALVAWDALLALLPLAAQASAAAEATGGFRAALFCLVQGVRGLLLAKAAVDKKRGAKASPDGQDRGSGSKPGKGTAEPLSANPFVAPAVLRGLEPAAKTACSQLAGLLGAAEMTTFSAQDVALYFARDDQLYREEGTYQAQEVEAKNVKKNKFQSALYGDLADELRPGSKPAPGAGGGPRGAGAARKDPRGQRPGQGAGSSASQTKTELEAEELALQQAQRRRMRASVDRTTYALQCLGLLGESMPAAIEPLFSVHEVARKSADAAGAPLVGPGQDSSAGRPERVAVTQLQVTFQELMRSPLVSLEALKALRRVVNGGLVPQNVVLKRSALPDALCRVARQLPLEASDVALLATIQPEAVLSPAAAALILPVVSAILQNAESSGLAASQQAMELLRQQLQLRAPLHAREVLACLSASLRAHPSLVNTAATALQDFCAYLLAGKETVDEPVEGEKASLLLTLLNVAVADEPAVRRAVVEALQAAPKDYLKKHVECVGYLLVLQQDVKEGDDEEGRRTHAKASKLLKTVWSQHDVVDQERLKDVGVLLRTPYKGFQLLAAKAFAALVADLGGASQLNVVMAILPQLFSWFSLEAYPEGAEKAAARREKRRLESLKAADKDDFGFPSRGGVGGQAAKPVIAYQKKDAEDPFFATGNAGRKGRGTSSPQSDSARDEKSPGERSGPGGELGESARANSPPPRRGALGAEEEQESLSMKLGVALALQCVAEKDLLAWEEAVQEVLRFLLTSALPTREAIEHESLQQALLSVGVSTIQHCGTDNEEDGGQAIQQDLFHVIERAAKKGGAPARTAEPAVAASVAKSEEKKARVDGADVQAVLNVACSVFFGAIAEKLDGSDPTVKKIIKELIACIVDSRSTSPDVQRTVSRALSPLIRLCASGAPQAGEVSENQAFCHALLSQMLDCALTGDDIVVRRGGARALGGIVKGLGILTLKTQHVMDTLKEALESKDGVRRQGALLCIEALSDALGRLFEPYTLNTLSLLLTSFSDTAFPVRLAAQQAARQIMAQLSGHGVKLVLPTLIEKLNDPQWRTKVGSIELLAAMTHCAPRQLASCLPQVVPLLSEVMSDTCFPKVRDSARDALFAIAEVISNPEIKHLAPQLIETLVDPTTENTKRMLEVLLTTSFRNSVDAPSLALVCPIAIRGLRERGSETKHKAANIVGSMVCLATEPKDFLPYLPQILVHLQTTLVDPIPHVRAAAARAFGTIAKGVGEEHLSDVLSWLFRTLKTSESSVERSGAAYGLSEVLVALGPDRLKAFLPDILANATNQQAPPDVREGYLGLFVYLPTAFRESFQDYVPEVLPVLLGGLADNAEPVREVSLRACDVCVQQYAQTHTALLLRPLEDGLFSPDWRIRQSSVTLIGTLLDRLLRGCAEGVAAEDVMQTEILSLERRAFILSSLYIIRSDEAAAVRQTAVQVWKSLVSNSPRTLKELLPILTKRLISNLAASSALPGGEEKQRVAARCIGSLAHKLGDAVLPQLLPCLQESLKSPDASTRRGVCIGLAEVVSSAPRSILSEHLRVLLQIVRMALADTDASVQNAASRAAGCLIDSLGNDASDRILPPMLSQLVEPAVYTPEQAEQTFTALRDAQLQGFELLLQQQTQAVLPRLLTLVGDNSRPLDASKLRLLGSCATVQPLERLQRNLKRIFHLLLEACSQTDLPEGADTTLLWTEASAASLRLIKRLDADGVSLLLSIVEEELRAAGPTIELTAHGRQQLLTRSAAVARANHGVNGHASSKKNDEEPEELSGARAGPVSAIPPSAFVNLKQLRAYPGFVKCVESDPLNGRRRRAVCEVVLLLLWSRGINAMLPFLEQILQLVLPLALTDPAEEVLVAGSACLAAINAQIKREDLIGFIPQIHGSVLRFLADPVTGKPVGSEVLTLPGLAISKKEPATFACSVAPLPPDFPAFSPSLLAGAPPSPCPSAFDTLAVVYQQGLMYGSATIREASSRALQQLVLHASSSAVEPMAVKLAGPLIRTVGDKFSGQVKAAILLAIKALLSKAGPSVKPLLPQLQTTLLKCVVDPHLAVRTLGCRIIGTVTSLHVSARVEGLLGDIVGLIQNAAATGAGALQVSLLQAATNVLRNLNGQCSPPTYEKVLDAAWEGVKSRQEEEARIAAGQAISVLLLKHASRETALEFLQDQVLESGNQFEADSRLAACLVLTPIFRSGADGWKLLKGSDVENDVFLLLGNLLEDQASVVQRAALEVFRVAAACSRHDLAVARHSFKLLPNVKTALAASGVTNTGALIAGLRGVRSLAKHSASLLADKNERYLLDTCDLASLYLFHQSPVVKLQAESVFRYALRVSGEDGHDESATMEALQQLQSWGFDPRRLQQVSEYAKRVLTRTVQSNNQLSDTDEEDDDSKDDLNDFEW

SEQ ID NO: 957 - protein, 1199 aa, Neospora caninum
MSGAAAPHPAMADLQRQLEQLLLASLDPAQVKPASEQLRALLQQEHEAQRRLAYLLLAKQIVDGCQEEVRQLSAVLLRRKISKAMAVFDENQQKEFITSLVARFSQEPSASVRRAVVHLLAAILRLATLQEAKRRELFSALSHMAMQNPSGADPQQLQQQVAAVSTFVAVAEACPDELADYFDEFLAVFRHAFTCAAAGNELGTSALKGLRSLAEFAEEPDQQKKICALVPNVMQIIAAAVQANEEDVATTGIQLIDDLLSNDNLAMKDAELLAVLDFLLKTVASRSDVDAGIRQQALSCIQWAAKQKPRVLCKSPTAVPAILDVLVAMGAEPDIQGGGPEDFEEDELTPHRIAAQCVDALAISLPSKYVFQPMLDRLTPFTQSPDVLKKRAALVLLGIMSEGCEGVMRRKMKFFLPFVLESLRDQQPIIAASACICFGQFAEYLQPEIMMFQREALELLLLLLDNPSALVQQKACYALGVLFENMEAQDLEPVASEVVQRLVRTLHQTSCDKVREVCISAIGSAAAASGNGEDAPSTGPRAFDAFAPELFSLIGQIIKMPTGDTDSQNAGQAVCSPTTKARAIGVVGGLVQGTSEAAYAQELPGLMRLIMEQMVIDASKDDDTGYAHDIRDEAFSCFSDVCVAMKDKFVVFLEDVMVRVFASLFSDEGLLHEEEKARHGAAAQLLDELDDEDDSDERLRNIRIRDGFLDELESAALCLKTLWEHCGAHCMKYIAKTKEAIELLQGHFHEAARQQCCYLIKAVVTAAHATFTGAPVKKESPKFALNPNVHTLWSEQLWPSLRKLLEEDEDNETVGDACVALGTLAEDVGPAVFFSREMNEEVVKQLLLLLKKKHPCQVIQDVDEDDDSRQEEEYLFEGISVLICGMAYAASAGSRQALQGPAAAGSLAAVCNRQTFAAVYQKIHPHLLDLATHRQSSAYAASGLGCLAEVFLAMQEDAAVYAADAKFLQAVLKGVQQDDNEDYRRNACFCLGVVYEVASAQPSVNAKTAEFLAALHSIFRSREVSEKTQGSASFPCPFCSSSLACGALAALSSALQEDLNKSEQLTLDNAAAAVARIILHPPASPLPLEHLVPALLVSMPLQEDHEESEVMLEAALKLADNAATQPLIVQHIQKFLVGVILETAHPLSAKRVKPEVQEKVIVMLRQLLTNPSLPPSTLQGVKEAVASKPFALEFINTKF

SEQ ID NO: 958 - protein, 961 aa, Neospora caninum
MALFRGCSNVIDESLDEFLVKHDPDYAGGRVRPEDTEDSTRWRASSPGPPSSADKPRTFLGSVESSLQERAESEAYKRSLSPRAGRARTDDDAPVKIDTQKLGRALSVAVTGLGEQVKHGGELLWRSAVTAAGQVIVQHGLQTRSGGPGASLAGFASPSALISSSLSSSSLASAVSSASCFNLQLPAGGPKAWGLMGLDPAGPMSLGAWMASPSVEADVWGDGNFNLLLQEQRQNGDVTGQLVAEPRAKDGEARASAGLFTYRWRRRFPNGVLVDVADVTGKVLEDVDDEFRGSQRSRSPSPLRADASRASMQPRRFPDGRREERASMPREEGKEFFVYVGHEEVVVTQRGIATTFSETDDFLGGGGINSLLDRRWSVRFSSEFPKLQLHHRHPRRFTLTLSEEKVFVLDAYTRHQRDLMAMTLRSFHARAVVGASTLLDLVHNMSCTGKAPVTSDEIISELEDKRVDLYMMVHSLSSELHRAVSSRLRTMRDWERVSKEKEALEEEMTSTIQAFQSQLADLANEQPAASAPPANGSSGNWNLSLLQMTDDMQALRAQNRAYVEEIEQLKVAQTEIVMRFENERHAFQELLRKRLETLMEENRQLQAANERLGSRLVKQASEGGVGSSAGVGPSSASSQEAPERQQVEMRRLRKEVEEAHLDKHQLAHELEEMKAAAARERQEKEAALANVQDALVHMKARYDCLLEEMQALRDSRDSAEEGVAQRVKVYEDLLLTRETQCNEHTKQLETAQHNLAELQAERNRLKKVLESITKDLERSRASLDAASARQQAVTAEKQQLEARLADMVQRQQRQEQLNTREEQLKQQESLRRLQEAQKRADEVSRQLEETRKALQQEQQHRQFQQQRADSGHQQAAALQNKLAEQDAQLTRMKAEIEQLTQTAQRTPEAEGGAGEGEESLLRAKVTELTDVLARQEEEMKRLKDESSTLKTRLIKLTKSNA

SEQ ID NO: 959 - protein, 516 aa, Neospora caninum
MTQVPPTAFEPYGPVITTSAGNPVDDNQNSVTAGPFGPAVLSNFHLIDKLAHFDRERIPERVVHAKGAGAFGYFEVTHDITQFCKAKLFEKIGKRTPVFARFSTVAGELGSADTKRDPRGFALKFYTEEGNWDMVGNNTPIFFIRDAIKFPDFIHSQKRHPQTHLHDPNMVWDFFSLVPESVHQVTFLYTDRGTPDGFRHMHGFGSHTFKFVNKSFHVLSLLCVSRNRYNEAFYVKWHFKSNQGIKNLNRHRAKQLESEDPDYAVRDLFNAIAMREFPSWTFCIQVMPMKDAETYKWNIFDVTKVWPHDDYPLIPVGKLVLDRNPENYFQDVEQAAFSPAHMVPGIEPSEDRMLQGRLFSYIDTHRHRLGANYHQIPVNRPWNSRGGDYSVRDGQMCVDGNKGAQANYEPNSVNGFPKEDKNAAVSGTTAVSGVIGCHPQEHPNSDFEQPGIFYRNVLTEPEREALIGNIAEDLKQARRDIQERQVKIFYKCDPEYGERVARAIGMPAAACCPAKM

SEQ ID NO: 960 - protein, 641 aa, Neospora caninum
MGAYLAKPKTQKVSEDGGEEGRTITSFGAASMQGWRQTMEDAHIATPSLRTGAPPSTAKTLEELTAQSGTAEKTRNVPAFAQDMSLYAVFDGHASNAVSCWVSDHFTKVFLDRLEQIEADARKGVSPAGLAESLSRELPDDSIFSLRNAVLCEALQQSFLDVDEQMKREENRQELKKYFEQGQIEQRDNETYIQRYLNDGGDVRLVEMDGQKYLQFVPRTSDEEDGEGASAVEEGEEKEKEEKKEEKKEEVEEASSPASPVNGEAEKNERTGAEGEVVNKLTRLNSTKLGDEETEEKDKKTEGEEEKDADKEEDDEDKAGDRPLFAHPSTPEGSGATAVVVLVVGGEDPVIITANAGDSRGVICRGGKAFPLSHDHKPTNPDEKKRIVAAGGYVANGRVDGNLNLSRAVGDLFYKQSKDLPAKAQRITAFPDVRITRITPEDEFVIIACDGIWDGKTNQEAVDFVREKLDAAGDVSSATLKKICEDLCDECLAEDPLQSEGHGCDNMTCLIVELSSSLKAGPKTSEEPITLYGGGEDKYLGRDENQFESDDNDDTPLTPGAPAWGSLHLFPPWEFKRVVREKQMLSRFHAIFLVYEQEKTFWSATRFSPDDAFRQVYVHRSMDVDRETSSVGFCSQQEEHA

SEQ ID NO: 961 - protein, 188 aa, Neospora caninum
MLLRVQALTPEVRAMYAEHGHYHEGDSGVDLFVVQDQEIQPGETAFVKLGIKATAYTPANGESGEKNVSWLIMPRSSISKTPLRLANSVGLIDAGYRGEIMAAVDNIKTVPHTLKKGDRIVQAVAFSGEGITLELVDELNKTARGEGGFGSTTAPVGKGCPVEEPELKKPKNDATNENEVPTAVAASS

SEQ ID NO: 962 - protein, 125 aa, Neospora caninum
MLQLNPQFDAIGKQFVQHYYATFGAQREKLAELYTEQSMMTYENEQFQGVGAILAKLQKLPAVVKHNVVTCDCQPTPNNGIVVLVSGDLAIEDNPPMKFCQTFNLVPNGGGGYAVFNDIFRLCIG

SEQ ID NO: 963 - protein, 380 aa, Neospora caninum
MARSGVNWPGLYRWSMEYHDGTVPRRMSKEDCDFLQNAIREAMNHQEDPAKVLTEQLAVIDGFNQGNPNIRPRNLVAALSVIERLIDDYSELARDFEKLGALQPCLRLLATCSTAAQAHETHHERPPVTSEEDDAALAATVVNTALTILSLIVANNPQIQEAVYKQQGLALLMNLVKEAPANSSLRVKALTALACEVRHHRQSELAFVNAGGLAILVHAMHSRDEKYQEKAASLTRHLLQEQLLGYAQVEKFDLPGAVGALLEHTPFTNIQFSETVVQLAIALLQQHRVAMAKAPVLAGLRQTLLDRQRHLVEMLREMEKRGNSDELLPDDFATQSSLLEEAISIAKFPGMKPSEAASTSGQNTRQGGVPTAHHAKMLGI

SEQ ID NO: 964 - protein, 455 aa, Neospora caninum
MSLATPFKSASEMLEYIQANQVDEKALREGFAFDGSSIRLFATVACSDMSMIPDPKTCWIDPFQDHKVMHVTCDISDPNGKPLERCPRRIAQRCEAWVTSLGLADAVYIGPEAEFFILDDVQYTCSPNKISYEIDCEEGTWNSGATLTAPAGYRNLGHRMPHKKWYFPVSPIDKHANLRTEMLLTMGDLGLPIEKHHHEVGCCQHELGFTFRTLVDAADLMMVYKYVVKNVAQKAGKTATFMPKPMAGDCGSGMHSHQSLWKNGTNLFFDAKGSYMKLSQLAMWYIGGLLKHAHAVLAFSNSTTNSYKRLVPGYEAPTKLTYSKGNRSAAIRIPLCDGDNPKAKRLEFRCPDAAGCPYLCFAAMVMAGVDGIRNKIDPPPPADCDAAEVDSPLVRSTPSSLSEVLDALETDHDFLLEGGVFTRDFIHAYIEMKRAEVAAVQLTPHPREYELYYHC

SEQ ID NO: 965 - protein, 395 aa, Neospora caninum
MPDPQYDPAAAQKSSNARAGGGSQRTTTVKGDRQSRVHTGNPHPTLTYDMGRVLGNGSFGVVTEARCVDTGEVVAIKKVLQDPRYKNRELDIMKELKHPNVVKLIDYFYTEMGERDSNDHNRFLNVVMEHIPETVYRVMKSFIRANQQVPFILVKLYTYQMCRALGYLHALGICHRDIKPQNLLVDSRTHVLKLCDFGSAKRLVPGEQSVSYICSRFYRAPELMLGASEYTTAIDVWSIGCVLGELLLGRPLFAGETSVDQLVKIIQILGTPSRRQMSTMNPNYTEFRFPDVKPREWKSIFASHIAATETNDPSWDQALDLLTKFLRYEPGERLLPLEALAHDFFDELRLPSTRLPSGGPLPELFTFSQLELQNMSPAAQVKCIPKHIASANNRG

SEQ ID NO: 966 - protein, 750 aa, Neospora caninum
MATSPSSFLLAFEGSVHSKAVRCVCVVPTNPRSASVKASFEIVSGSLDSSVVVWSPEEAPQGGEGESSPRTVFKSRLCLHHHTDFVYSVAPCHSDPTVSSFFSGGKDKRAVRIALDNGRVLMEYKQASPCLLFLLSSASRASTDAHQDIIRALDLLALAASSSSPPHATVLSASNDQLVKAWRLDGTPLGEFEGHGAFVFDVTASRLQPNTFLTASDDCTCKVWLVEGSEVDKALTGRAIQTLLHAATVWRVAELPTGDIVTCCEDGKLRVWTRDENRALPEAERMKQEHEAQEAQAAAAAKGESSIDVSSLPDVSQMASLRGKIGEMKMFREGDLATVYTWQGTGWERVGEVVGAAKQKTHYEGDAYFEAGEYDHVFKVEIGEGGAYKPLPFRMSDNPLVAAEKFCVREGINKSCLEQITSFIRRNTGTSFSSSSSSSSSSSSSSSSLRPGAPSQVGVFDAAVASKVAPLMEVFTFAKGNFEGASKKILEFDAQFPADSPERLTALETQYLLDALEKIKSPSFMKQGFRACEIDVLFEKLATWPSSKAMPVMDIWRIMALHPQYHLVHKKTGDQGWMTVIVALRHLKDACTSETDESPLMLCCLRFLANLMDLTTNRTVMLRHSAVILESVASDRILKSPNKNVRLTAASLLANFSVAFANKEEKEARLKLLKLLRGVMESERDLDIYYRCLVALLTTLVTPPQPQQRRLLIDECQAIDMAGALPPLNQNIPAEGRIGDAAQDVLLLLE

SEQ ID NO: 967 - protein, 2325 aa, Neospora caninum
FASPFGASAPPFALPLDFNRPASVSASRSSCPSSPASNACSRSSSPQSVLSCATSPRKSDLDCADHVSLASSSRDPPRSPPSLSLHASSESSSGPHAREGDAERCRVPASPSLSPSSCGGASLASLSPPLLRHTDRAPPPSLSAETSVRGVSLGVSSAAPSSPQSKMEGEDDVSLFKKGEKGSRTRLASKPSAECADTAGGDSGARTPPPTGATDDPTGALSPERPTAQKLSETPGAGVSPALGARKTPRAEDAAASPSSAPQLPRRLNDGAVVEGPLPNELEMVIPRFRARFLEGIEDEGDSPIDTLTLYSDWVELPSLRFRLMVHPLTRSHNRQAQLSPPSPLFPEGAARALSPQQQEYLQSRTTAAFVEIGRKPDWPADWIFQSAVRFHIYVVNLTEPERSVWREETFQFSCEEIDRGWHAIVSYLTLFEERFFAAPSGDLVLRAAVFPAGTAVMSRGLRTPCPASPPLGERRRPSDSADPRDTEAAEAEMRERSDRGGGDEPKEDDAELGPVIAGQPVDTSSPLASLFSSLPPAASLGRAGKGYVGLRNHGATCYMNALLQSLYYIGKFRQAVYALTFDTKAISGCRSIEVLESRCRRRKRRAGGSGASADGDEARDARDARHDRNLDKDEDMIDGSCDVQMEDEGSALRPTGRASKGASGRPSYDSSPYFSPVHHPLASLLLNSDDEDDEDFSDWNERDMRDLLLEEEQEQRRPPSISLALQNLFFRLYTSKEPVACRDLIRSFGWDAADAFTQQDTHELLKLLLDKVEEQMQRTPAEGSVKKMFEGEMETYIECIEVDYKSVRKETYEDLNLDVKGCNNIQESLRRLVQPEILEGENSYDAEAFGKQRARKGVRFLRFPPVCIFLLKRFDFDYEKMDTVKVFSSFEFQSELDLNEFCPGAGVYELHAVSVHQGDVNSGHYYCFLRPPPRTQWVRFDDDKVYPVSEYAAIGDNFGGDEEDPCNYLAGKAPRSRQKVYNAYILVYVKKRLANQLLADCNPMKVNPQVVVRCRTEELLMKLRNRIRRVLEQRIKVKVYHPLQFLNRRFLDLPLATMPPLVEIKSSRSVGVLPIHEQITSRLFAKLYGEESAGASEGGASQRSSAKAPSIAFLLYAMDFLADDARFSPVAIADNPCLGEIFRSKMLGNGGRGSGVLGHRTFPGSSADQNYPYNRFDACLYFLAVPETNAVIRSALDHDEFCRRHQLLFLKYFDIFGANKMLDAEPGSAQDPKGKRKKEDSQAKPPLSAGKGEKKLATLETQDEATEGVPESLRDSNVVCVDVVLVPNGWRLVCLQPHLYRRLLRCMDDGLVRPYAVESLRRYVASLGSLPPLFAVSGSGSGLFFPLTGSEKPCLVDVASSQSCSLAACAAAYGAGLSATLCGPVFSTQGNFPALSGSREQTPDLPRDAALALVLALEIEFQDLKNPTSLTLSSKKTFSQEKIFPGDIFVFNIEAPENMRRRFQEIRRLAEVSSAEREPTTTEEFGLSASADGHDLLAQLYLDGRGLPNVPSLLPAFCLAQTPLVAADGAETKHRASLSAEEGPVSLSPSSSSSSSPSSSSPPSATGAAAHAISTAARAALGDADTGDKAEDEKETPGTKQKPAEGPGPSRSAEASTTVSSPVNSGVLPPSRASQRQDAAEGKKGDSSAGQAPAGSADGTESAKKEERPAVMPPSSDGGLLPFLPAARGGKIPVGPPEMPLLPSPDFHHYSLNKANRFVFQFRLYDPLELLNRPMNCCGMLLEDYPRPSTAPSASSVSLASRDLSLSQCSSNETLSSFTLASSPSTSSVLAADPYLPGASSKAVNASSVSSSLLLPAASPSPVNPLGATAGPFGAATAVGGPGGPAGPQRSTSGVSVGDIDCADGDGAGDAEEDEDPWIHVPKGQPVAAKMLEVDVRVACNQVLRYVSWYLGTDSSRLFLFPEPPLLSDPAYEPVSIDSLVCFANEGAGTAPRRDSSGGASPEASMRRLSVNEVFSRLEKKALQCTGSRLGRRRSRTALGAFPFSGTSGSRPRIFHLALMPRHYSLCSRVIDPHALSPAQLERAKDLIFPACSGTSSAPSPPPDVRLHDALLHFVVLVFNRRVESLGCVEGLIPARCPFSSRPLTVKDLIHAILARMPPALRTQVVEERRRLSREAGAADAARVSDAALASGLRLVASTVASLQELEKTQQVQNLPMYALGEAHGPIRQPRLDGLATQNLFAVPLRLELDWTPDEKEGIENGDLKVLQVVHQTPTDREYFGYPFEILVRPTETLNEIKHKVKEKLLLPKALWNNWTFFQYADCNRSWKGPNDRLDWQRYDSITLIAEHPAPYSKMRSHTAMKIA

SEQ ID NO: 968 - protein, 271 aa, Neospora caninum
MADSGEPGDTRITQRVSTIPGGTTTTTRTATYTVRSVPVTATSSYAVHSCGSTTGPTTTMARFTFDDLKRYLEDQGKIIMDDPRTKQLIESGQATWEDVKEYLDAHAPRTRPQEGTNVVYSTTGGYWYPVVTGTPVVAAPNSIFEVGPGSAEICNKISFRPRLDAYYDANGKRLVLLFDLPGFEKKDVEIELDKGALAISGERPKQGESMLGQESNGIIKERPFGFFYRKFQLPANAAEDSIKASMEQGVLEVAVGLKDEHTITKKKIDVQ

SEQ ID NO: 969 - protein, 582 aa, Neospora caninum
MNRAQSAGSLKDSLSFLEMLKKQIDANLQHHKPGECPLTKKDILDLGQLQKEIDFQENVHAVGITCAQLFHNTAPAVLYEQALKKEAGSLIASSGALCVSSGLKTGRSPADKRIVEEPSSKDDVWWGKVNIPFCEKSYLVNRERAVDYLNLQDQLYIVDAFAGWDPEYRIKIRVITTRAYHALFMQNMLVLPTAEELENFKPDFTIYNAGCFPANRYTNGVTSQTSVAMNLGAGEMVILGTQYAGEMKKGILTLMMYLMPKRGQLPLHSSCNVGPKGDVTLFFGLSGTGKTTLSADPSRQLIGDDEHVWTDKGVFNIEGGCYAKCKDLSKEQEPEIWNAIRFGSVLENVIIDGTTRVVDFRDVSITENTRCAYPLSYIPNALIPAKVDTHPSNIILLTCDAFGVLPPLSKLTPDQVMYHFISGYTSKMAGTEIGILEPTATFSACYGAPFLAMHPMVYAEMLAKKLKEHNAHAWLLNTGWICGGYGMSEGRRIPLKYTRLMVDAIHDGTALQTEYQTMSVFNLAVPIAIKGVPSDLLLPETCWSDKNKLDAQVRKLASLFIENFGNYTDRATPNVVAAGPIL

SEQ ID NO: 970 - protein, 483 aa, Neospora caninum
MDEFLHVLDKEFGLRPVVSTLALAESPDYAAKFGAHDKIVGLVKSLQANEYVLGEQAEKTVWSLTEEGQLYTKEGSPEFRLVTWLQARGNEDPLDVPAIKAGFGSDADVAVSNAMKLQWLRIDKATKIFQINQVPKSDNVRALLDVVQGQRDGNHDEAALLERLAELAAPASPEKTLQELKKRKLVELRKVKYLKLQKGHKFSLHLTKPVADLTAELLIGDAWEKSNFKEYNFFAAGKKIRRGTVHPLMQVMKQFKQILHCMGFEEMPTNQYVESSFWCFDALFMPQQHPARDVQDTFFLQAPKSSDAAKIPQAYFNSVKDIHEHGGHGSIGWQYEWSQDESLGNILRTHTTASSARMLYELAQEYKKVEGLVADRGLTIGHLMGVMETFYKQIGIEQLKFKPAYNPYTEPSMEIFGYHAGLKRWIEVGNSGIFRPEMLLPMGLPEDVTVIAWGLSLERPTMIRYGISNIRQLFGHRALLGIA

SEQ ID NO: 971 - protein, 246 aa, Neospora caninum
MLVPCPSPLPAVRPLHDEAEERSLPVSLAAPMERRFSPYVNNGGTVVCVAGEDFAVAVGDTRLSTGFSIYSRFQSKITKLTDKVVLATSGMQADKTTLHNLLQIRIEQYTHQHRHPPSLNAIAQLLSTMLYSRRFFPFYTFNVLCGIDENGKGAVYGYDAIGSFEAARYNCAGTGAHLIMPVLDNQISRNNQQGEKAPLTREQVVDIIKSAVASAGERDIFTGDQAEVVMISQSGIEKTLMDLRAD

SEQ ID NO: 972 - protein, 116 aa, Neospora caninum
MPKCMIYSPVAATEAQQDALLKDAEKALAEVLGKPMSYVMAGYVQTGLMRLGGSSDPCAYIRVASIGGLSSSANNKIAAALSASCERHLGVSKNRIYTTFANKSGAEWAMGDRTFG

SEQ ID NO: 973 - protein, 1100 aa, Neospora caninum
MATTQDSSSAAARIDTDLYSRQIGAFGLETMGKLITLRVLISGLRGAGAECAKNLILAGPNTVVLHDPAPCEMRDLGSNFCLTEAHVQKRLSRAEACKNDLAELNQYVTVEVLPDAKLTEEIVARFDVVIVTEAGNEELKLYNRFCRAAPRPVGFVATNVFGLAASIFVDFGERFVCLDSDGEEPKEVIVAGITHERAATVHTHTDKLLPFQEGDFVVFREVQGMEEINDLPPMPIRVTGKHSFQIGDTSAFSPYASGGIARQVKMPKTIPFKSYEAACRAPVADGEAMLIVPDLGKFGRSEQLHLAFQAVLNFRDQSGNDALPHPLDAARAGLHRQAVAACVAEAKRLNEEARLRAEEEGKKGDHGEKGIVFVDEVDEKIVSNVAAFAQCEISPMAAFVGGVVAQEVVKFTGKYTPLRGFLYMDAFETFLPPEAKAAIVQDTKNVASFSLQSRYADQVALFGPEFQNHLGRMHAFVVGAGALGCELLKSLALMGCGCGPEKEGKITVTDMDRIEVSNLNRQFLFRREHVGKAKSVTAAASARAMNPDLQIVALEDRMGVETEATVFTDDFWQGQQIIINALDNIQTRQYVDGRCVWFGLPLLESGTLGTKGNVQVVLPSLTQCYSDSADPPEDSIPLCTLRHFPHAIEHTIEWARDCFQGVFCDAVGEPNKFRENPEKYLERLRGEGILSVQKDRLEKIRDLISQWQDKDTKAFSPPSFERCVEKAVLLFQDLFFNQISQLLYSFPLDHRTSEGTLFWAPPKRPPTPISFDANDPAALDFVVAASNLFAFNFGLSAVRDRAKIQAIAAQVAIPQFTPKRLQINTDETEQKPNGNGAQAGASVPAPARLSLSLSTEAEEETVARLEKDLLATTDLQKMVFVPVEFEKDDDTNFHIDLVHAASTLRALNYKIPCCDRYKTKIIAGRIIPAIATTTAMITGLVSLELLKTVTYKQRKLEDFKNAFVNLALPLWLFSEPMPPNRVVDKDFDPVACGPIRAMPKGFSCWDKIQVDIPGCTVQQLCEFLEEKFDVEVNILSVGNFCLYNSFLPVHKQQRYKKSIVQLVEEVTKTPSQQSVAVESSCSAKSDGVDVLLPTIRVLNK

SEQ ID NO: 974 - protein, 363 aa, Neospora caninum
MIGKLDMADSGDKDDFPAVCRRLSAAFRHDLIQRAEEKFFRAQLLSVSTLSPADVVLFVTVASQLRRLLLSGERDSAEGTDTCRETTVQNRCSGRTWCELLQGKIIATVFFEPSTRTRCSFEAATLRLGGQVISCGDMQTNSSTKKGESLEDSIRMFAAYSDCIVLRHPEKGSVERAAQALKSVRRGRPPCALLSAGDGAGEHPTQALLDLLTLVQLRPLWWDAQLKKIEGDSSCVRGPGDRKAMEAGHQPETSLRVAFVGDLKNGRTVHSLALLLSRFDCHLTTVSTESSALPPSVVACVRENFKAQVMHPLPRREEIAVDVDDTDHCAYFAQAENGLYMRMALLAIFLNQRTARLLLGEAS

SEQ ID NO: 975 - protein, 555 aa, Neospora caninum
MSPNPVVVVCRKVYVGNLPVPVTQGEVQQYFNELLNSLLPQKVPGDTIVHVYVNPARRFAFLEHRSIEEANFTLGLDGVSWRNCALSLRRPQDYNPTLADQQYREERARLGSMTGFAVPPPSQAATPAAPAESSLIAGALGIVSTTVPDSPHKIFIGGLPHSITEQGCKQLLEAFGQLRALHVVKDQQRGDCKGFAFCEYLDPNVTDVAVAGLNNMRIADRVLQVRRAMPHGQMKAGTDGSSSPAPAAPSIVGTLSKVIAIHNMLPPLPLVPVLLREATATEARIRASPYGEVLFVDVLENLATSAAAKGEGVPVLVEFRDVDSAIQAMAGIQGSTYDGRSLSVVFAEPSAGMKKAAVLRIIQEAGGSAAVPAKARPPPPAASAGVATPAKTDPSGARELQQEQGASPCPGHSEEGAESDKKCPSPAVQASACAPVSRSPAEAAAAGSAAVAAFLFGGSNSPATGRGVESSQQNGQRNAGTESDSKADSGVPSQIGDRHGPATGKTENVHDLSEQAGSEAQKDGTGSLPAAAPAAAPAAGEDTVAGNSKEEEKQG

SEQ ID NO: 976 - protein, 723 aa, Neospora caninum
MPEHSEVMGGRISRQRGGGQQAPDNRRPNPASMSTISSRQSVSASDRKAGVSRHHGSAQTQSSRLHAPTTSQRVSSPTSSEAGDQRSTVSGKTSSGRPRGPNLFSGSSKNKASPSTNSTSATASLSPQPYTPTPDAHKAGTGASPAAGTGRRCVPSPGAASAAGREEVSSRHVIRRPSESRVASTSPTPRDKEGGIDRSKFILENTGALTDFYEIDTATLGQGTYGSVSKARKKDTGQMRAVKTISKSQVKNLERFRQEIAIMKDLDHPNVIKLFETFEDHRNIYLVMELCTGGELFDRIISEGRLTEKQAAVLMKQMFSAVHYLHSNNIMHRDLKPENFLFLDSARDSPLKIIDFGLSCRFKKGEFVSTKAGTPYYVAPQVLQGKYDFRCDAWSLGVILYILLCGYPPFYGETDAEVLAKVKTGVFSFSGPEWKRVSEEAKELIRHLINLNPQERYTAEQALQHPWVTTLARNSQNVALPTTLMSNLKAFRAQNKLKKAALTVIAQHMSEKEIDHLRQIFMTLDVDNSGTLSVQEVREGLKRLGWTEIPADLQAIIEEVDSDKSGHIDYTEFIAATMDKKLYMKEDVCWAAFRVFDLDGNGKISQDELKKVLGMPDVETAVGRATIDALLTEVDLNGDGEIDFDEFMYMMRKKEPAEKRFDVSSRKTLHATAPSQETRRSVVQRPTLGTGPPRASVASRSGTVAKGPPGANCKLESAGAASS

SEQ ID NO: 977 - protein, 272 aa, Neospora caninum
MASLQPGDGYGGDGFHRFPTVSVDGAPRPATIIFLHGLGDTAAGWADLISLLSSLPCFPSLRVILPTAPVRPVTLNGGFPAPAWTDIFSLSKDTPEDREGFLESKRRIDAILRGEIEDAHIPPERIVLAGFSQGGALAYFVGLQAPYRLGGIVALSTWTPLAQELRASDACLGKKDKEGQGQTTAEGETQETQGPRGPTPVLHCHGEQDELVLFEFGEESAALVKQQYAAACGEEVAKEAVKFRPFRGLGHSANPQELAEVRLFVESVLKPQ

SEQ ID NO: 978 - protein, 170 aa, Neospora caninum
MSILRHDSHPIAEDAQGAYLTFDTASRGTIVLTWSKKAVSDALIYFHPRKPVPAFKYTANGGRMQLATNVQLDPTRYFQGICAFLKTLKQFDGELTVISQNRGPKPIAVVLHIVGTNAVVKCERGVAYDLTDVDVVGVIPVDCVEFDCKTLSPSLFREKAERVGAALTVM

SEQ ID NO: 979 - protein, 2878 aa, Neospora caninum
MHTASVSNGGGAAGPTSIGRSKTCGSSSDFPSFSPSPLRLACTLSSLILPLVSPSAPIQKCSLRLSATAPGAERRGEKKANGPLEKRDVRRRKRDRATPSDQALLLTTRTPFVDGKNSRESMSLHKKARAAGSPSYESDSEETEAGNLESAGGLQVRNLGSLTQRPDRRRSGGKNSVKEKAEETSCRQARKVTGVANLTLWPQPNKSRRERATSGRGEEGFSCDGRPRARPTAVKGGDAELVRVSAFPHEEETRDTVQLSEDPTTEKGNGADPRRNMDDREARSSGKEREGQAGKTGFPCLSVSSFCLARPAPKTQSADAGHAASRRGSENATDTEFRFSTTHFVAACGAHLSHEAVAAASKTREAESPSSLDALMSRQSGGLAVAEDDSREGRPRLPAASACGREKDTDGEDMAQTVSACTSLSTLSSVGEMPHDESVSASVAFASSVSSVSSVASVSSQSQMRRAEADAATQRAGSAGKETEVRQDFEDEPFSSCMNPGGFGNREGSWGREAEREGATRVSSFERKARSAASATAEASSWVFVHRSGEEMERELESDGERHEERHRRFPATPPGSGDHTASGSSVSSLRSEAEREHERMLNHALSMLRFLQRLHDKTKNRFQRRTGFEEEAEATHATSPFSLSLLALHSPHARKERDSREANELGHAKATGTRGRPVAGPSSSLAFASPSSGFPSSRRFSRGATGEEEPCARRGKETGASCSVCVGDVGKRTRIPKETAEKLERFYSLFEQRRARRTPGSSVASSSQQLGGESPRFPASRTEGFEGDTGESRPEVEFAGSRNGAEESKSHSSVGTAGGDPHGVSGGDTASLPLGAGGAPCVRNVGDAEEPKSCHVRAPWRPLLLRTAENGQEVAENGGNGENGEKGIMPPGVGTASPSSAPERTFSTHGNVSFEPTDAFVSLPPSGRLRGGRRTFTSTRESVFRGGSCRDWKERKREETVSSRGRERAARNRRVASSPVASPASPLSRRLVRTSTEGPAWGSAGVSARGRRLGPPVAVGALGSAPARLSVNGDTETARAFDVGDEAVGGGLTPSGGAQGNTRVRGSGRETLREQAKETTHTSERPGGDEKAKEGERKRVRGVNREEAHPARTETKVEDAKEKVEDTPERKESGTEGKDGAREQSEREGGPRVMREKEKTRVDTDGEPPEKVEAEVSTLPESEEEETFHLTGVRGDTGSPRAQGGKEKAGAETSNGKRERAVEANGPEKTARESRPFDSSQGQSRLQGVVEEETPSSREEAEETEGTKLEGEVGEEGKGDTGKLVESRNLNGTPKLAKTVPAGLLEKGVETVSQSNADVSRSLRYEEEDQRGKSTEKTSVCEQMLLQDAEAHPNAKRGGPAKEEQATQREESPHATRHESAALRSAVAACSLPSSASPGRKREEAGQEDPETEKRWERVHLCLPHAPQEPGFTPPPADGLSEPLPPSDSCQCAASPARPVPSTESARSHAAETEKEVPKARAAPGPGGDERRRDPQHHKSCDTGQGATGGGCGAGGRQSANSAQGRGPRGQGAPGGGVRIPELIVRWTEPGAEVVEWTSATKREDGDLPSLRDAEAPPSSSEADSTAPVWVAAASGDGLAVLHLQFKFIVDGEWRCSHAFPVRDDGNGNLNNVAALFRCRPPSKSGAASRLDAGCASREASLGLRPTTYNPSRSPASFPPAAESWEVSYRSSSFFSPTLQLSSALAMSSACFYPNFDETLRKLESEGESQHARQRNRFVFYSYDRCLVDACTSCEEDETREDCSSRVEKGTQTQKANEMPQPRDSPRRDTVRLPPHKNTMQSLPSPSPSPSPSPSPSPSLYPSLSPSPSPSSSSHSAALSFASTAERGTTLGSVARGLLGGGFNVQLLYHGLSPLFSLSSSPLSVAASVSGSAASSDVSEANGRRRPAASSSSSSSSSSSASSSSSASSASSSSSASSASSGAPTRELSPACMHQLCARSSREGGEEKEPLRSAGSQGRHTPSSRSQRRERQVPEDGNTPAPPSCAGDRDVGGAAGGRARASERGCSGSATAWGRQCRREPDGIAGDTRGAGHLSQGEEGERERALFHEATMSGCSKPRRGRQEEGATDGRQAMGADEGAGGVGDGKTTRNGAHAPSLSHALRHARPLPSPEAASASPPCSSVSSPKASGVFASFCASALSSTSFPSSPLHASLASLEAAASLKAALSSVAGASPAHAEAAGRASASEAVGSLRSPKTRPSTVSLGPGGVFRSVSASERGSVPLRGTPQGDGSTRRGTTTQESTWPAQVLAHLHGPEILLELTQAHAEREKTGGDLAQWRPGSRRRRLTDGKGGDEDTCEDGTHARAARTREALQTAEHQEDSEESGEESGEESREESREESASGFEERRAQRLCLQCGAYMLPHPDKLESGGADAFFIASGPGDARLTEQISSLIPEVGNKSLSGSHSTSPFAAPPRSRDTRGVSTAAAAVCVGVADGVGEWESFGLNPRMFAEELMVGCWRAAVAEPWFRDFQDAEAAGGRAEGLASPRGEQTGDGRGRGGTGGGAVRRSGEAETAAERGAERASSLAFSQGPRGGDGSRPASPSSPPVGEAACSDPPLTESVGEGKGEDAGARGKRPCPRSPEGFSPSPPVSCVSADLPATPTSCVASSEGAVSGGRVDEAARKALRILREGFKEARSFGSSTALVVCLDGLRGRLGIASLGDSAMMVLRREHRLCRMTCAHRSQEQQHQFNCPFQLSCLPRPSEYQALAAQGKETLVRVLRNATMLPQDTPDMAQAYSVHAQEGDLVLLGTDGVFDNLFDYEICALANLALSPYEAEVLGDTARATSAQAVAAAVAEAAAYKSRSPLAKTPFMKHARRANTHFMGGKMDDITVVACWVTRGEEVEGRAERASI

SEQ ID NO: 980 - protein, 1295 aa, Neospora caninum
MALSIREADAKRLLWTRLSDPTPATGATPQTAHVPAYNGFASSDAAHVDESCSLLRGVCVAVDSTTDLEDLPSAHPWLLTSRLTVKPDVLLKRRGKSGLVKLDLSWADAQKELKALMGTQFTMQGLTGTLDHFIVEPFFPHDVAANEFYVAIRTLREGDEILFSHRGGVDVGNVDEHARRVLIPIESQAKNDAEPISAMTNGCVPAAVPAAAAPCSTSLSAGDAMKGNVNGSTQPKTLEEISKRGSECRLTQEELVSLVAPLVTDVAGNEAKKALPVFLAELYRQFCEMHFAFLEINPFCFDAATHAFAILDCAAKLDHTAEFLCDKKWGHICFPSPFGRRFTEEERYIRELDSKTGASLKLTVLNPKGRIWTLIAGGGASVVYADTVCDLGFGDELCNYGEYSGAPSEITTYEYTKTILGLMTAPGSYREEGKVLLIGGGIANFTNVADTFRGIIRALRDFREQLREFKVRIYVRRGGPNYQEGLKRMREVGEELNIHVKVFGPETYMTSIIPFALQDEEGVDASKSESEKEGEEPVAATASGFAATPATMNDMIGDFAQHHGWDLSLSSDVFASAGRATSPLPDSTSAGIVPVTPSSRESRGTFVHGGRLSPWHEMTMEEVEKNPHFEKYIQAFLAQQKATDTPPAGEASHSTVTASGDAGTGNALASLLTDSHESQLFTQTTNCFVWGLQTRAVQEMLDFDHACGRKKPSVAAILYEFSVSHQRSFYFGTEEVLLPVYQTLQEAVHHFPEVSVLINFASMRSAASVTRLALETAPQLRTIVVIAEGVPEREARQLAAETRARGVCLIGPATVGGITSGAFRIGNTGGTLENVMNARLYRPGSVGCVTKSGGMLNEMNNILSIVSDGTYEAIAIGGDRFPGTSMLDHLLRFERNPDIKFLVLLGEVGGGMEYEVVEAIKDGRLTKPLIAWCVGTCASLFSTEVSFGHAGAWAGSHREHAAAKNAALKAAGAFVPSSFDELGKAIRHVYVQLVKQGVVVPRKEVPVPRIPMDYAWAKKLGLVRKPKGFISTISDDRGEELLYAGWPISKVLGDQLGVGGVISLLWFKRPLPEYCYRYLERVLMLTADHGPAVCGAHNVIVTARAGKDLISSLISGLCTIGDRFGGACDQAAQQFLGAFTSRMAPAEFVAEMKKQNKLVMGIGHRIKSVHNPDMRVQLLKTFCKSNFPQTPLIDYAEQVEQVTTKKKDTLILNVDGLIGVSMCDMLFHCGHFTENEARDYIHNGCINGLFVLGRSIGFIGHFLDQKRLKQGLYRHDVDDIAYVLPDWSSSENKDK

SEQ ID NO: 981 - protein, 1146 aa, Neospora caninum
MAVASPDPQQLCQVLEGTYSQNEDVRKTSEQYLQSISPSPGLLAALLKIVQHDQIDVGVRTSAAVMLKNEVKKHWEGPGAGLEDSDEADGAAGARKKEEFYSAEEKAFIKENLYQALIQVCPVSQPVSQQLLECIRLIALHDYPASWEPLLPAVTTDIAARQDSSRLLCALSVLRRLCGIYEFKRTDKEALDAIIERTWPLLLPAAAQLLNEGGLGNTDAMQMLKLICKIYWSSTQVCLSSSALVVSTMDDWMQLMEQILVRPVPPELLSGLDAAERCELPVYKVKKWALQIIQRAFSRFGDQKLLNRATRSSKEDVAQAFGRNFATKWAPRFTEKILLLLRQRHEHPEEVQFWLSPRMLNLMLQFLLLATEAAKIYASLLKPSGEFLVSQVCVPLLQFNEEDDELWQTEPVEFVRRQSDALESFSDPKEAGKKELRARQKNVQRPLPPKRMFPLAPRRRLSVHACLVFLVAVRFWIAACEFIKALVRYRGRDFLEPLYLLTHRLVDEFRTVAQQAAAANQALPVVAYQKKDAALRLSCCISDRLLSKKRQAPVEDFLALFVLPDLQSPNKFLRMRACAVYEEFVPKLATWKNPAALVEAYRGIVLLTQDAELPVRVQAAISAKVFFSVEVEELQQVIVANLEGLTKQLFAVMKDIDNEQVVATIEQLISSHEEHIAPYAKDLTQALSVTLLEMLDREGAAEQAGDDSAEEDAAFASMTVLSALKNVLSSVTETPALYSEFLADLYPVFDALFAPDAINLLDDAIEILAFITFYIPAPFPPQLWRYFESLHQAVCGGSTPARPLSEALQNGWAVDSVGDMIAPISNFMCRAHAQFVSGQNELGVSYKACVLQIGKKCIEDLDSTDACLGLQLLCLLLECCAAQQTADDILLPAFQSVWGWVLKLNAEDGEEIDKRTRQMFIKFVLTLMVYDVRKFFLLLEEQGATAQVLSFVLENVALIKTYEQKKVFILGCTRLLQEFAAAPAAFPACVAESQALITKALATQATEQAQLKQKLKEEEDNSDFETDSDGDSEQDLDETEDAGLHPKAKEILEKLDNVKWGGDDDDDDDDDWDEMYDSSCDESGGLQSSPLAEVDELKNLREVLAALPPEAQAQISSWLGPIQLAKLNEVLTEAPPAAAAASSTSC

SEQ ID NO: 982 - protein, 429 aa, Neospora caninum
MAPMPSPQAASPGSASADSREKTGSCVSDENPVSNGTAASSAPTLFGCTYTTDSSRPPAVATDAVLVVSSPTPDDALVVQGIDFEKCRDLDSLLNSFEGSGFQATQLGRAIREVKRMRAWRLSDDPIDESDVGTEWEDMEKRKNTKCTIWLSFTSNMISSGLREVFVFLCKHKLIDVLVTSAGGVEEDFVKCLAPTIVGDFYLKGEDLRAKGWNRIGNLLVPNSNYCHFEDWIQPIFDKMIQEQNAKIQANAGSPGFCVADAVWTPSSMIKRLGEEINDERSVLYWCAKNDIPVFCPGLTDGSLGDNLYFHSYRNKGLIVDIVQDVRNINDIATKCKKSGMIILGGGLPKHHTCNANLMRNGADFAVYINSGAEFDGSDSGARPDEAVSWGKITCEAKPVKVHGDATVLFPLVVAATFAKEFHEKQKQL

SEQ ID NO: 983 - protein, 307 aa, Neospora caninum
MEPAAASADCTKRGTTATKLGLAEMLKGGVIMDVKDAQQARIAEKAGACAVMALEKIPADIRQSGGVARMSDPALIEDIMKAVSIPVMAKCRIGHFVEAQVLAAVGVDFIDESEVLTVADEENHINKHKFQIPFVCGCRNLGEALRRVAEGASMIRTKGEAGTGNIVEAVRHIRTVNREIALLTALEDDEVFSYAKQLQAPLALVEETRRLGRLPVVNFAAGGVATPADAALCMQLGVDGVFVGSGIFKSACPEKTARAIVEAVTHYQDAGRLAEVSRNLGEAMAGLTMDRIERWAGRDTCETKRRH

SEQ ID NO: 984 - protein, 258 aa, Neospora caninum
MSPLGFGSFLSPLLLFSVCPHLRTGISRSFSSLLKPQKFRPLVSRECPSVSGRFFIPSPQIPSRCFASLPASSKMAIKVLVPVAHDSEEIEAVCIVDTLRRAGAEVMVASVEDNKLVRMSRGVCVQADKLISEVQNEVFDCIAVPGGMPGAERCRDSAILTKMLKAHKEQGKFIAAICASPAVVFQTHGLLEGEKAVAYPCFMDKFPANVRGEGRVCVSNKIVTSVGPSSAIEFALKLVEVLYNEEQAKKIASQLLCS

SEQ ID NO: 985 - protein, 396 aa, Neospora caninum
MAPKKKEQAEEKILLGRPRNTLKMGLVGLPNVGKSTTFNLLCKQAVPAENYPFCTIDPHEARMNVPDDRFKWLCNHFHPKSEVSATLAIFDIAGLVPGAHRGEGLGNAFLSHIQAVDGIYHVVRAFEEPDIVHSEGEVNPVKDLETISDELRMKDVERCEKLIEELDRLVGKGQVPKDKQKKVHLDVLKVVLEHLNNKKWVSQVDWKASEVEVLNEYQFLTAKQVVYLVNMSEKDYIRQKNKWLAKIHGWVEANVTGPIIPYSAQFENKLAELPDDAAREKYIKDVGASRSQLDKIVTTGYHALHLIHFFTCGEDEVKCWTIRQGTKAPQAAGVIHTDFERGFICAEVYKYEDLVAAGSEAAVKAAGKYLQKGKDYVVEDGDIIFFKFNVTNSGKK

SEQ ID NO: 986 - protein, 350 aa, Neospora caninum
MNTELLSLANDPAILVRLCDIRTLPSTDALVTKAERILAAEEISSALRYRQEDDKRMALCSRLLQQQLLCSHSSRHRGIRSVSDLLRAMDSQCVGRERPYVFGGASGIGEEEKLRRFMKIWTMKEAFVKALGTGVYVDPARLECVLPEFDSPEACTPAPSLACPYTPEYDLSTDTYAFSPAKTAGPSVALSSGGSTSASTQETFKSLSLESEEDTGKERKIVRILMDGEEQKDFGFVWLDATVAPGFVICVCWGPVQAAQKKYLECMPEREREAIKSTTARRISRDPELPKRFSWDEALPSNNGGGNSTFPAASRLPRFDVRWVSGETLLQELHTTSGSSNDPEPNLRLA

SEQ ID NO: 987 - protein, 230 aa, Neospora caninum
MRPSSGSGIGRPDSMSKPQVNSAANEKIALYSLILYKWSPEKPIQLAAAFDLSSFPFFHRSTMKEHIVFHSRLICARTPLGRRQVVEFEQNIGHCHVFVHSSGLAATVLSTSAYPMRVAFGLITQALRGFQDIYAGQWENITDDVKEGTMFNKEGTDLLKLYQNPVEADKLLKVQRDLDEVKDVMLKNIDDLLQRGEKLDDLMQRSEDLSNTSYQFYRQAKKNNQCCQLY

SEQ ID NO: 988 - protein, 2579 aa, Neospora caninum
MSLFGSSPGRSSDSDDDRSLRSPSRASSAGLSDPEDAQRSAGNEREDASSLREEAAKFLWGGSEDEKEDEGENDLLDADDYIQASSSSAAKLTAQPGFSADGEDETFDEEVPYAPRLLLKDAEARSRKEKLLFAAFNSLTHTEVLLSHAADLATHVSRVHTAGQGSEGASLQAVPRLSDEHRRRRSLSAAPHAPRLSLSSRKSWEAEQDAEKRPVIGRPSRSPRSSQTLDQASRPPAFSEAHSDASAQPHPLRASFSSRSSSASGGETGKAPAAGQLAPKMMKVMREIFGKRKPVGRFGGYGQLAAGRRDGHAAKPNAAAASQAGYPTPSPPPATSDPVAQKPLASPPVLAQAGQKVSVTVTDEAVRQLKDINLLLKREGCAGSLRRQRAQELYDFEDGHMLYQHPRFCATAIFRENLVARRLAPLWTAIAARYDAVEGSDDAQQIEQQQHLLVQLLRCLAFLAAAPPLDWIQYWMKFAPWLDDLKRTDDFRKKEKKRIEELRARRRRLGLPPSEAEKETEEKFFRDEELHRDPPVQEERRLRSHIIMKYYRGMQDAKKALCCPALWQLLASVFVDKQDFVDRGGRTAEQQRRLDGLAAEREALYKREKEMKSRLRELEEENAQEMDGAADSLPKHRLKRASVGAKAALEEEMRALKSEMEALREDIFEITETLHDLNRANREELEKAEALIDNLRMLVCAVFLMPPSLPKSVAMTPGSQLSLVIAMLQQRKEKALALSPLHPGGFSLMHLFLRDTQSDLFSRMQKAFSLVELASSSNPQEQEFYDIEKMTGGLGRWAVTHVHAELMERIWMVLRTVHGLVSAVPPLAFAELVAEITAGVPSSSSAPQPGPSRAAGRSRFAACNLQKTSHEYIQFLSRLDPLKARQVLLAERVVAAEQRNRKVAQVRVFRDQNRFVNYERLFLFRSLALRPLDLEEEIGEGLEGHDQSPGKETPTSARVATADGGDVRSDAGEAGEKARNAVSSSAASSGAVRSATARHGPPAAFASKAAWLKTALSREDLRSLQKLISGFLGIDEQFTAPVNPETHENDMYCGRFYSLAFLVEAAIKELLREVDTDYHCPWDAELLLNLISWIFAYQVTYFKAVNRLRLARRSSAPLLDRIDMIFCLQGFETALIQDYLVGLFHRAVFVLSLSRGSRPLLLSCLQCLRQLLRLLQVHVNSKKTEIVDAVKTQLASWIKRGVIGTLAHVMKTFKGSSFEADVFLYALEIVLIFASLLQAVGGRIEVVGLPRRGLGMQRRGGRSRGSLLMDDEDGPGPDGAFPGDAGDAPGLPTGSREVSVDDVVREFLRGEIVHQAMQILAHYSTNAVAVNSAVISFFELILSYKHGQPENAAFFFDVSYFLVFRNMLNDRAARTDPRVSWILNFAEDIVERFFFLWGGDDAETGRDAETGPGDGVGSDKRQDASAVGESVPREEGQASAAEGQNGNAFLPLELLFSKKKTGRAGFDNSPADVFCPTSEGSFASLFSNYRTGSDALLLAAMEEQLKTHGFVAPLDAAAECRRNLGDDLGFAGRDAANKFDKHEDELLIREFLTYRDINNWDQYIATTLGKTARAVRKRLQQLRLTNPELFPSDFSPDEDALLSSRRTSVDAGAPAASPASAVPPLLAAVQTLWERFLASRLPSEQEPPSFSRFLQSLADNFADACRLREVLRMDALSEASEAGRASGVWEAVAVEEPLEGGEAAVELLASAEFARLMQAMGAERREGRKDAGAPDEGVWRIPAEHPQEILEAAVKKLKELVALDHEELAALAAQHMQRERQRDEVRANRLKRRPFVFNSASLAEALLNFRFFLQGLEDEQARRASADVGDERGEAGFEAGRRGEGGGLFASETPAERGDGARTGEPADSVCSLSGVFRDKSADAILTDLLTVFKSLSAKLLARREAGEEPEDKERDALELRVEQFAWFACESIGESTQLRRTLAVMGCFRDFPGAQDEEGDAQILWQVPLDVDAEIFDDRVDAFANFAAKGLDELEMLVQGVRGDQVGRSRRDEDEETWDDEAVSAQASSQGRSKKHESRGGREHGKKGCSPSRRKKKDKRDKRSRPLLLTLEKLKKAAASGSGLLPEKPSTRHRYLLASKLFLWREFLESDEINRELLHGDRPLQRLLACLRQWNTERLAVLERAAEEAGDSDEEAAIVRRNRVPHLVLTACREQEEEVAFSASAAEGGEDGDMDEDAEGGERKGRPAAGEETEEAGVRFRVFRGVLPNVAAGLWVCAALGGKPVEMSENREFLWRAEERYLPASWLRKQLRILELVLLNPHMQTAAGVQVELGLIREAMEREEAQRQEEEAERQEEEERRLDENGRPAEDDAETADGRGDAGRSREQERKQKVKRREEDGMGDDQSVSADKKHEGVAKSKTSEQAVEEGGEAPEEDDFDLVPEPDEPADPTCSLSPRKETEEHSDLDEDYEMFLEPSDAALSDDALFDVWDVVGSGDEGDEPERGSRGARDEGADGADLLTCLIDDLQSFQKRRSPSAKKPSGDGQRQKKRGRETVESGAPEASERTAYEADAGDKENAVHNVAERKTRTGGDIDRVKRLMRSLDTTFAELEQVQES

SEQ ID NO: 989 - protein, 392 aa, Neospora caninum
MAPTTPSPCLLNNVAGTRLASSAKDASPSTAWLTSPEVLEAATDPKKLSTIVEKYRTPEQKLLSQQMKEKESEEPLLIANPRRWVILPIQHHAIWEMYKKQEASFWTAEEIDLAQDMTHWESLNSNEKHFIKYVLAFFAASDGIVLENLAEKFLSEIQIPEARAFYGFQIAMENIHSETYSLLIDQYIRDEKEKMELFDAVHNVKAVAVKAAWAAMWINNRNCFAERLVGFACVEGILFSGSFCSIFWLKKRGLMPGLTFSNELISRDEGLHADFACLLYSQLKNKLPDKVVQDMVREAVTVERAFICEALPVDLIGMNNRSMAQYIEFVADRLLTSLGVPKIFFATNPFDWMELISLQGKTNFFEKRVGEYQKAGVMADKEQQKFVLDADF

SEQ ID NO: 990 - protein, 674 aa, Neospora caninum
MPTVSVPRDDLFRRLGRTYSVSEFEELCFEFGIELDEVVEPGKDGATETIYKIEVPANRYDLLCTEGISRALYAFNNPDAPLPAYRLEPATPQFTMTVRTAVKQVRPFVVCAILRNVTLNKESLASFIEFQDKLHHTLCRRRSLVAIGTHDLSKVQPPFFYDARPPKDLEFVPLGCDSQMNGEQVMAHFSNHLQLKAYLPLIQNSHVYPLILDGKDRILSLPPIINSEFSKVTEDTRDIFIECTAVDITKAQIVLNTLVAMFSEYCKEPFTVEPIQVVYEDPTSAPIDRSAKCSSEEPARNGEASMNGWAFPRVESRSMKFSLDYVRQLTGIPVLTAETCTNLLKRMMIHASGGRETTADILEASIPITRSDILHERDIVEDVAIAYSFNKLPITPSYMLTGDALNCLSEKIRNFCTVCGYTEALNFSLSSAAENAANLGRAPGEGSLLFNPLEYQVAPHPVRLANSKTREFDQVRTTLISGLLKTVVANKGRRELPIKLFEIGDVCVLDSSTEVGARNLRYCCVAFADEHSSGLEEVHGVLDALLQSLQFVGEYAIAEMEAAVAAAAVAEKAGGEQAGAHAAEQLQRVLSRIRGTFKLVASQEKTFLPGRQVHIVASRKSSDAVENVPVLLGVMGTLHPHTLKAFGLTIPVSILELNVEAFVQWLPAIDLVVG

SEQ ID NO: 991 - protein, 528 aa, Neospora caninum
MAPSNASTSGEGSAGAGCIEREFDYDLAVIGGGSGGLACAKMAAAHGAKTVVFDFVQPSTQGSTWGLGGTCVNVGCVPKYLFHHTALVGKGAHCDGPHMGWQGKFEEQIDWSVCVEKVQNYVKSLNFGYRTGLRKAGVTYINAYAKFASPHELAYTFRGEEKICKARNIVVAAGGRPHIPEEVEGAKELAITSDDIFSLKQAPNKTLCVGASYISLECAGFLRELGFDVTVAVRSILLRGFDRQCAEQVGLCLEEAGVRFLREAVPVKMVKQPSGKIQVTFRVGTAEPKELVEEFDTVLYATGRKADTSKLNLQAAGVETTETGKIICDDDSHTSSPSVYAIGDAVQNFPELTPVAIKAGEILARRLFANSTEHMDFTNIPTTVFTPIEYAHTGYSEETAEAKFGRDDLEIYLFQFSPLFFSCVHREKAEIARKSPEDVDITPPCLAKLICVKSEDEKVVGIHFVGPNAGELMQGFALAVRLGAKKRDFDKCIGIHPTNAEAFMALTITKASGESFVASGGCGGGKCG

SEQ ID NO: 992 - protein, 140 aa, Neospora caninum
MAEAVVVPRSFRLLDELEKGQKGQVAEGVSFGLEEADDISLTKWSGTIFGPPGTAFENRIYSVSINCGPSYPDEPPEVCFRTRINMHSVDPTGVVLRSSFPLLRSWQRHYTLDLLLTALRQEMAAPANRRLPQPPEGDMY

SEQ ID NO: 993 - protein, 302 aa, Neospora caninum
MAKLEGKNIFLTADGRTYHLGVKKGDLASLIVTVGCEQRARFLASKYLTDVTEVASSRQFYTFTGKYIKGGHRMSIVCIGMGAPMADFFIREASFVLEGEPMAVIRIGSCGIVDFDTAPGTLMLSDESMYCYRNYCHFDGEAALGKKTGECDSRPYLLTAPVKADQHLTDLIEANLKKIGAAVKRGLNCSAETFFACQGRELPLWNDQNADLMKDVTSLGVVSLEMETHQIFHLMHQRQHGVPNGPQSHAASLMIGLVNRNNPSFTSHVSSEDQEKATLAAGEAAFDALVSLVSEGILKPAA

SEQ ID NO: 994 - protein, 627 aa, Neospora caninum
METMKISVKWNKQEFEDVEVDLGEPLALLNAQLMTLTGVPADRQKLMANRKLLKSVEDLRAAAKGGKSVKVTMLGTAEGGELQQPAEKTVFLEDLTPAQQAQLLREKNIEPLPTGLTNLGNTCYLASVLQMLRPCSELTRAIKSDMRNTTGDSAASYTALSGAAGAVHRLAVALKDFYGQWESTVGAVQPVLLVHAIREAFPQFARKAPAAPGGLGGGFMQQDAEECFSCLMTVLSDSLPVSQNRKAFEALPARYEKASNFVDALFAFDMRVTTRRERGGTALADAEGDAPAASPEIKRDKNTKFTCFLGTMQNPINTLDEGLKFSLAEERIDLGAASAGSAQTGAAGAGSEAASVTLVRSMQFETLPFYFLVQFMRFEWKRAGGQAEKAKVCRSVKFGPTLDLYMHCTDELKESLRIGRAVVALRREREAGGVKDTQREDEANAGKETSAVAAASDAVMADEKTPASTEPSAAGDSTVYRTGFFQLLGIVTHQGRHADTGHYVGWTKKDQREPRVIEKEKKQKEREEERKREENPSGVALKKKKAAPVDMWVKFDDDKVTETPWDQIDLAGGRSDYHIAYLLLFREILVDATEEEVQTVEKSHAEQMAQAQAVNKLPNGEEKKAQE

SEQ ID NO: 995 - protein, 426 aa, Neospora caninum
MYFGSFPFGDDMRGPGPRRGGSKEKNNTKFYEILEIDRTASVADIKKSYRKLAIKHHPDKGGDPEKFKEISRAYEVLSDPEKRRIYDDHGEEGLEGGGAGADPTDIFDLFFGGGRRMSRQTSKKKGEDIVSAMKVTLEQMYSGATKRMAINKDVLCKQCNGIGGPADALTTCPDCDGHGVKVVTRQIGPMIQQTQSVCPACKGAGKTMDASKRCKSCTGKGVVKERKILEIYIEKGAKNHHKVIFRGDADERPNEIPGDVIFILEQQEHAVFKRRGNDLFMTKKISLLESLCGYKFVLTHLDGRQLLIQSPPDTVTKPEAVQIIKGEGMPQQKNPFLKGDLFIVFEVEFPEHVSDADAKKLAQILPKPTEAVMVSEDDPHVEIHVAEPVDPDDLRNRQQTQRSGEAYEEDDEDEHPGQQRVQCRQQ

SEQ ID NO: 996 - protein, 475 aa, Neospora caninum
MEPLADPLNDRVVTSELRSHLQREGRLSKEDCLELVKNVTEITSNEPNLLRLNDPITVVGDIHGQFYDLLKLLDVGGDPDTTQYLFLGDYVDRGSFSIEVLLLLYAIKLNHPTRVWLLRGNHECRQMTSFFNFRDECECKYDMTVYFAFMEAFDSLPLAAVINGKFLALHGGLSPELKVLSQIGGVNRFQEPPRGGLFCDLLWADPLDEAKDDVGQSPEDSFTPNDVRGCSFFFGYAAASKFLDRNGLLSVLRAHEAQLEGYKMHQTNQKTGFPTVITIFSAPNYCDVYNNKGAVLKFENNTLNIQQFNFSPHPYHLPNFMDVFTWSIPFVSEKVTEMLYGILNPSVDDDEDDEDVDDVELPPAVLSILKTHLPADEASGQRHPPTGDSRMSKERADALRKKVQSVGRLMRVFKTLRQENELIVRLKGCTPGHRIPVGLLLQGREGIANELDKFENAKQIDLMNERRPDGGSSSH

SEQ ID NO: 997 - protein, 377 aa, Neospora caninum
MSSQPQRNKLRALQVAAEGRRKSSKGQGELLRVLRQQRVFVDERAIHFVSEGRQGPRADARNSVFKLQTSFAEKSETDQEQSLRKKFSVMHKENDESGDEGWGNQYATVPEALKTERGKSILAEQNRDELLDAIENIEAEAEQLPEDTVTREEIDEKAALNQTIQRYSVAAPDALSPQQLEALAKIAESSHTEMTAEEDEDEANDEDSADDDDDDEDFTSQDLHKLNDMQREFLGNNMIQWMNSMEAGYRHGMILVKINCLGVAFIRNVIIKDCLLIIAQPNNWLHTAINPRKVALTSVESVSLGRNSREFQAMEKRIQDGTLDEKLPSPKFCAVVHLPSYRTLSLVFVDEEHRNGFVFFLRIMMQKAKEAEKKASR

SEQ ID NO: 998 - protein, 598 aa, Neospora caninum
MRREEEETGPKKAWKSGTTDGAGNAQAMAESEAAPGKARVAAPVCGSDAASCRDTGAAEEPQATEDGSSPSGVPKRDAQSAALEEARRAENANSEEEAAMEECFADMVAEAEKLKAEGNEFFKTRLFHQAVEKYTAAIDLICDNTMTAQTKQILQVLLCNRAFCQINLENYGSAVVDAERVIQLNPLFAKAYYRRGCAYCCLSRYKKAQKDFERVIALSTTPDPSVVSRLQECKKQIRLEAFAAAIETEKTMRASEAVRKEGVETLWPVEKSYDGPVYAPEGGNYCSADFVGSLKEYLKDTSKRLHKQFAYRMVLDMISLLGKLQTLERIRIGDEEEITVCGDVHGQYYDLCNIFEINGMPSKQNPYLFNGDFVDRGSFSVECILLLYAAKLAFPDAFHLTRGNHETFEMNRLYGFRGEVIHKYDERLYNLFCESFRLLPLAFVLNDAVFVVHGGLLSRDDVTLDEISKIDRDREPPDGGLMTDLLWSDPSPLPGRSPSKRGVACQFGPDVTAAFLKLNNLKMVIRSHEMKDEGYELCHNGQLVTVFSAPNYCDQMKNKGAFVRLDGKTLTPKYTQFEAVPHPATRPMQYANPMLSFM

SEQ ID NO: 999 - protein, 248 aa, Neospora caninum
MAQTPASMLAAGKFIVDSRYATTEQEESILQDITARFPNVVLMKQTSQLRAMMTIIRDKKTPKEEFVFYADRLIRLLIEEALNELPFEQKEVTTPLDAPYQGVSFSSKICGVSIVRAGESMESGLRAVCRGCRIGKILIQRDEETAEPKLIYEKLPVDIRERWVMLLDPMCATAGSVCKAIDVLLKLGVKEERIIFVNILAAPQGIERVFKLYPNVRMVAAAIDVCLNSKYYIVPGIGDFGDRYFGTM

SEQ ID NO: 1000 - protein, 2723 aa, Neospora caninum
MAIGKVKRNPDAGVATAVQSVIQHQTFKRMLLFGLRSLSDFCSPSNQLYQENALDAMERGVLVAIQTAVTTFSDDDDLMLCAARVLWAMSVAVKEEMDSAHISRLHSEGSPVIVAIVNSSPTDPQTIEDTMNFVDNMNRAGAPIDGASIAGGMLSIFSKAALGMKTAKRVTAALAIAAETAEGSTALYNAGGTSVLLTYCLDQGDLSDAGVEMVEGAFDTVRHMAVNQCTDATTLPQCITLMDKYRGRKSASAKGSSALAAMVGPEQLQKCLNTLKSAEAGTPEYDEALVTLGSMSYISSFTDEIVRAGGVPLLIELINSGLPQMESNPDKIASMISGAAKMLARIASNPLNVDAIVQAGGVATLCTAVSYCTESMEALGALCMALVPLASRESLAHEIVQYQTFATVLPILYQNVENPEVASLAMELVATGSQHEEIQEHMLQNQAAEICSLCCQYHTADVTYQQHAISALNRLVPRLTTLHGVSEYGGIQGVVASLTANVNNEQVALLAVQLLDNFSEVADAKSYMNDGSCVDAVLAAMLEHEGNDLLISAGIHCLGRIATEEDCSRHLNVLDSAIQTARGNPDGVYRVLAAISGLSRVPSLRQIFEQKQAGKKQIRKGLLLQICQGCSMARHAPIHRIIELHVPGAVERRFLKRTRIFILFRGAFARVLVPCPLASTDLHLSHKEACAVPFFTADTILAGISSWIECTRFEGQSRIIKAALKTVKNMKISGDGDLTSCFVAMCEVACLPQVKRVVELEEPDNNILVSNTEAIRELAATMRIVGAENVERCIEGVLKVMRKYPDSRRAQLHCLETLNYLAQCDGGAGVAILSRTGGLNAVVQYLTRAPMYLDSQIAGFTVLATCAKIDPSIGETLRKCNCLQALKVAMRTHAKSKELKRTIAPLVALLMPTDALEAEITELLAECSAACDKNNFSQLHENLAALNELLISSEGAKIAARANIGQHMCKFQEYIVSHEADALAVTDYDILGKDLFDATVSECAHAMEQVATVRSGRTALIKAGNVATLINLYESLKGPQSQYSEEAAIHCLEALRLLLKSDKRSAELAFERNFVSTLCVGIDNFPHSAPVLGATCGCLAAMATTPERVQMLTSQPAFELLLQKLVFVIQNDPSRENKMVAMRALQELLEITNDATMANKIAEAGAVTALFRMIDEYGDDDQLSVQAAAVLALLGAFEDLRRFYDNDVRFPAQVLTAALAKQKNNEPAVVHILDVLNKLVTVEDRAVLRELGVMEQVADAMRVNSESEAVTRLGGELFAKMGADEQIKSLMLQIIEAVESGAEDTAQRVDILCARLAMFLAAPLEDPKDALQHTEKCLGSLVATLQAYPGNERLESNIALVTRRLCDRCFDDANDPYGAWAVASSGMLSQFANMIAGETVANNKKFLGSAYRTLTACCVNPYCMPTMVEVAPTFLPQTYALLEMHKNDAETVSRILEFLRYFAEDATACGLIMQNMSGSSGDMVALTVLLMQQHQNNDQVVCAGMELLGALAYTLSQAGYEPLPKLADGSVLRDCDALVGSNSSSARQLAHMHMIEKMLLSKSYNDALVKEQELKKLVMNLKAEDDKKRLSDDERAGLYSAMACVLLAAGGAGLTGELEKFNCFEVVLQAIEEFGENPSVIKEVNRALQGLSVADANMTARTVKEAIPKLCTEATTAIQTDPECADTFCDLMLQLVSQEGNGRQLLEVYGMEETLQGLENLAAYYGEDFGTQLSEKVAMIRQAMEDDQPREKTCKDVYELLNARVAQGLSVAISEVAILQGEVEYLFSQMGMYNQEQLNHQTAMGADHQYGNMAFELLASTPANVKLLQANEFSKMEFALIKGQKDEEIVLYAVKALAAFCKFPPAAQDTARIQGCPALVTEACAKINKNGSLANDRKEEHLCARYFLVERTAINRNLYNKTPIMTELISSWNDYDKGMYTTTVLRHIFRAMRRVVSDAHVEELLKANVLQRLIGIVSDVNADVALLPDVLFLLGSLAVVPEIKTKIGELNGIAACTDLLNRSLPKPNTAPVVTNVCLAFANICIGHKKNTEIFSKLGGPALNVKVLNDRGHEYDVCNAASVLLCNLLYKNESMKKLLGTNGAPAALVKGLSNYDGSEDKTAIRCLESVFKAISNLSLYTPNIRPFLDAGIENAYSTWLSNLSETFPDAQLETGCRTLANLVMENEENNMRKFGVCLLPCMAVAKQGRTDTKALILLLDIEASLCRLPENAATFADNGGIETTIRLIHQFDYDVGLLTLGIHLLGIQSSVKNSIQKMLDADVFSILVGCVEVDAEGNEVTDLVVGGLRCTRRIVRSEELAFEYCNAGGIATIANVICKSINQPMVMLEACRVLLGLLFYTTRSQAERQAAVEALHAECQQRAQEMHAQAQADYEAGAVAEPPPEEMEVPEPDPDELANAAYGGWYQMGMDEVMIDAILQAVCACATVETHAKQLRLQRVCLGLAAYFASEQMGTSSLVGSGIEQVLTQIMTNFAGEATTMQLSCVIINSIAMTSGDMFDEIKTPELLAALKSSVGKMATKKAEEKALKESCAMTLEAATSGADPFDAFSKTVTELDFKFTEWNVDPYPNGVHDLPSNVKEALRKGGKMKVFLPGKESEEIKWRSSQDLNVFEWCMGNDTDFNNRIPIVRIRNVAKGLVHPALQAAAKKEPRKITPKFTLCLFGPPNDDFPNGVELPMKAKTQKERDSFVEMMVQWRDAATYNF

SEQ ID NO: 1001 - protein, 215 aa, Neospora caninum
MATPADQAWPEAKLKAENVAYGPEDEAADTQEEFDDSKYDVTNQRRRQSYLEYFGLTAAPAEEGAAAGGLTVPDSGHRKSSAVSILFDAGKFSHWTDLYQKTRGCQPVLLKKVHVRVEVLQPGQAPGVLGARDMWIAVHAHGKACYGPAPCACDDWPMDCRLAIVKKPMNDLIYQAPNKNCTETVQVYSVYTDVNGERYIRLPQPDATEFWEKAP

SEQ ID NO: 1002 - protein, 390 aa, Neospora caninum
MIIGCPRERKQGEGRVGLAPAGVLELVKAGHTVLIEKNAGEKAHFTDEHYIQQGAEIVASVEELFERSEMIVKVKEPQPDEWKLVKPGQILFCYFHFCASESLTKAMLKSGAICISYETVQKDGRLPLLEPMSEVAGRMSIQCGMHFLETPHGGSGVLLSGLPGVRRGRVLILGGGVVGTSAASAAAGVGADVVIFDKNVDRLRTLASIMPPNVSTRCAGEDALLEELSLCDLLVGAVLIPGRRAPKIVRREHLKRMKRGSVIVDVSVDHGGCVETTRVTSHHDPVYEVDGIIHYGVANMPAAVAHSSTLALTNVTLPYILCLGKLGWVQACLTDSALMLGLNVAEGKVLHPGVAEAFGLDSVPLSEFLEGAQGAENNKRLDGLKGTQYV

SEQ ID NO: 1003 - protein, 774 aa, Neospora caninum
MAPKKKGISVNLRDLQREMGVGVTLLPSAPKPVDEAALAAAEKERERERKLGPGGGRWADRMDDSDDDEWRRESEGANFGPGGPGGRSMEGMRRDGGRMRPQEVELPDEPWRRSAPLPPREQDGGERAGRGRGDEEDADLGVLRSASKVNTPPAGGPGDVGRGGGNAGNRQHEEDLDFADLRKSTPQREGSFAGQRGPREDDEDLDFAAVRDRARATVGSAADSAAQSSDSRPEHLRSLRSRLKKVERENVSPPVENGGASPALPSSRPLESQSSVESKPGRYVPPSKRTPAVGKDEKGAGPRGSSGAAGTPPVQNERLAAFLEPNSPRKAPAAAPRPAAANDVGNGAVPASTPAPSSVGEKESAASSPSEKDDLREASSPQTKAASGGGARFVPKWKQRMEEEKKKEEERAARASQATQQAQHPAASLAQSLSEDSREASSAARGQNVSPSSFSSTRVEEPVQILQPVRLGTRKDAALGGSFVNGKYVPSGVRQQSQQSASFPGSAPKESAVQRLFKAAAGVTSTSPSAGTGLDGEDVEELKRQEELQKKKEEKERRERERFEEQRRKREELVKMLTHKEDEILLLVQALETGLDQAETDPSKKLGVDDIVAVLKDEDELASIVPCAVVAAVVIKRSAGKENMEGVLEVVKPVQDVWKALLEKSQVRDKDQVLIKEMVKMIKAVKCPRLSPCTALIEAIWDAMWFDDDNDDTEGRTEVLFQVLTWGQWLQGQLPGADAGEEEEAEHEEPDNDDYDIEALVPKREGEKSTKKKK

SEQ ID NO: 1004 - protein, 400 aa, Neospora caninum
MERLSTCRYDPLTEVPLPPGIVLWTPHQYYDGAGWLALPEHEKLQMKPTRWADGRLRFLDPIDELPEPFKAVQSGKFDVKCWRRGDCKLGIEGDRTVFLKAPISPEVAVYVHADRLPAFPKTWKPLVFILNQSVAMFRLTENLCLVLVVENDKTMNISCVDYNGGFACTHPKTNMVVAYGSYIVKTFEKLSNCAAIPKMVTASGDWGFFVQFYPWGFFFIPKSLELTRPQAVLGAVGMGKKVDTIGLVFHPPNMFINVKLDLPAKTTRALQFGKDFQVTAKKTSETDIEIFLIIDGQLAKYNYSFDIRNNKPERPKHTDNIHFKCTCDAEEKKKPEPRFKLTACKDSVVLLEQGCPCGNPDEQLVSEQVIAFFDAEVCLYYTHPPALKLCDAFTDVAIRE

SEQ ID NO: 1005 - protein, 528 aa, Neospora caninum
MASAAASGPPQAPAAGSTEARRTNPFLEFQVVVLAGGSSSRLSSLTGTPKEKGGCSKALLPVGNRPMLWYCLKNLQESRFGDAIVLTRQEEQAEILAYLRQEFPNAFQRLEVIGLGRDRDAEKGKKSEDGEDDFDDDVVCGTAEALMQIKHLLVTDFFVITCDVIGPVDFFSLANLHRVENAACSVYLLRRDYLSEGASEILDRSAQGKGGKGGKKKAASEKVDKDANKGNPVAIAFEETETLLLGIQDRHSISHGAQLAIPKLTLFYHPSVFVKANLYDPHVYLFKLSALKILEAPKLRHTLTSIRFDLVPYMSLMQMTPQASLWSASRLDCDVFDELLDSFDEPHKNEKENSSREQDYTLANRPEQPRKGNKVVFALHPDCAGICCRVNNIHDYYEMNMKFCSNRMDELRGIMPEWMLPGQQAKKYPTMRDSNVAEGSTFDESAVVKRSVLGPEVTVGPKTRVTASILLEGAKIEEGATVQRCIVGRKATIGKDCKLTNCQVRHGYSVPPGTVAEDEVLPVFADDA

SEQ ID NO: 1006 - protein, 671 aa, Neospora caninum
MPAKEGKLLTGLMVNNSMAGGKVEFVPQKGNRVCWYGCGPTVYDASHMGHARTYVTFDVIRRIMSDYLNYDVTMCMNITDIDDKIIKRSIEQGVDFLTLARHWEKEFFNDMAALNVRLPSVVTRVSEYIPEVLSLIERIVKNGYGYESQGSVYFDTQTFRKTDKHIYGRMEPSSVSDESRVLEGEGELGLTSSEKRHPCDFALWKKAKEGEPSWDSPWGKGRPGWHIECSAMADSILPFPLDIHSGGIDLRFPHHDNELAQSEAANDRPQWVNYFLHSGHLHIHGAKMSKSLKNFITIKECLSRFTARQIRLLCLMNRVSSQEPHLLLPEKPLTFTFSFAFVGVAVSVASLPPDARVHSATGPKEGWDSFMNYSPDGETMQQAIDVDRSFDNFFALVKAKLRDATPVSDYAQKWGADDFALNEQLQSAKEQASPLEELRNCDVVHKAILDNFSTPEALVALQHLMSATNSYLNQKTGEDVKAPLIKEVAKYIFHMLKIFGVVEDDEEDLAYVKAQGSTAAAAAEIEGLVECVGAFRELVRTSASQGMRAVNQALKRAPEKSPGESDASPIGAGEAEGELLQSLSVTMSTLLQACDEAELQAKKERERQVPPADYFRVLHADLYATFDEQGVPLTLKSGEPVSKTQRQKMLKQIEKHQKVHEQWLASRGQHA

SEQ ID NO: 1007 - protein, 505 aa, Neospora caninum
MSCDVGVYGLAVMGLNLSLNMASKGFRVCVCNRTPSKITIAVQKAQEQNLKNYIGVEATDEFVAALKRPRRIVMMVQCGAPVDALIEHFLPLLDKGDCLVDGGNEFFENTERRERLCAAKGILYMGLGVSGGEEGARYGPSLMPGGSPEVWALMKPILVQIAAKIDPNGAVPAPGATTFTQAELDNACVTHIGPGGSGNYVKMVHNGIEYGDMQLIAEAYYLLKYLCGQSNEQLEKTFAQWNKGELNSYLVELTSKLLTKKDALTGAYLVDKILDAAGSKGTGKWTVQQAADAGVAVPTIAAGLDMRYISDNIELRRNMAAVYAKSWPTGSLTVSGNETLPTDMEKALLCGKICCYAQGMQLLSVVSERKGWGLNLAEISRIWKGGCIIRAAFLDTMQKAFSANPSLKNLLMDPQIADMMTANLPSLQRVVATSLSTASPFGEQAFPIHLSVPCHSSSYFYLAANASDRLPLNLVQAQRDAFGSHTFRRTDVDGVFHEEHWTTGA

SEQ ID NO: 1008 - protein, 1034 aa, Neospora caninum
MALTEEEKKAKIEEISARGRAKGWSGEAVRSAYVDFFEVHGHLIYPSSPVIPRGDNTLLFINAGMNQFKPIFLGQVDRNSPLSKLRRVTDTQKCIRAGGKHNDLEDVGKDVYHHTFFEMLGNWSFGDYFKRDAIAWAWQLLTEVYKIPKDRLYASYFGGDPRLPTCPPDNEARDLWLQYLPPNRVLPFGAKENFWEMADTGPCGPCSEIHYDRIGGRDASSLVNADDPSVLEIWNLVFMQYNREKDGSLTPLPAPCVDTGMGLERVASVLQDKQSNYDTDLFIALFDKIAELTPGLRPYEGKIGEEDKDLIDMAYRVLADHARCLTAAIADGAEPSNEGRGYVLRRILRRAVRYARQTLGMKEGAFPQLVSVVVSLLGSTFPEMKKNEEKVIRILHKEEQQFSRTLDNGVERFKKVANSLKAKGVKVFPGSEAFTLYSTYGFPLDLTQLMAEEVGLQVDAEEFERKFDAHRVASENTSFKQGGAGAVYALPPDQHHLLAKNRNLAPTDDSAKYQWNVKDLAALVAQDAVEAAPVKAKVAAIWDGKRFAPDAAAVASPTSENFVAVILDKTCFYAEQGGQVGDVGRLVDLSSGAEFEVIDSQKSGDYVLHIGTVSKGTLKEGSELVPLVDYVRRFKLAQHHTGTHLLNFALREVLVRKMRKNAEGGDKREDTNGLHIRESCLNERELSDEEDIQQKGSLVEEKRLRFDYAGEKPMENEDILAVENVVKDCIARERPVHYREIALEQAMKIPGLRAVFGEVYPDPVRVVSVGSPIEDLVELAVSGKGETPFASIELCGGTHLHNAAQIQDFCIISEESVAKGVRRVVAVTGDPALEARKELEELEKAFASLAAAPRELPALEKEVLKARGLLDSAGPLPLVGKRVLVKQLEQAQKSLLELQKARSKELLKEAKRLGEEVGNEHKTKPFLVLNLPQLHGDGKALDTASQTLHQTAPELPFLLVTANPATGTAAIAFVPASCGKNAVAAPWLNACVGSLGGKGGGKGERAVGAAKEGDEDKVLAAVADATAFAEKNLA

SEQ ID NO: 1009 - protein, 469 aa, Neospora caninum
MADDELASLAATKRQQILPYGRVVNFAPGPACLPVEVLLEAQQDFLNWRGCGMSILEMSHRGRYYLKMLEETKGHLAALLNLPPSHHLLFMQGGATLQFAAQPLNMLRASGDTADYVITGNWSRYAFKEAGKYGNMRVAADNKANGSVDLPAVTEWSLNPNAAYVHYCDNETVYGLEFPQTPDLSQARFLPPTELPLFSSSSPSSPGPGDAGANGSAEGSNGNGGEKSPAEYSAKTKLRLTSDMSSNFCSRPIDIEAHALIVAGAQKNVGPSGVTIVIARDDVLGKELDLCPSMCSYSLCKKADSALNTPPVFSIYIVGLMAKYLRKQGGLASWADVCARKAKKIYDVIDESDVFLCPVAEGARSRMNIRFSVVDPSHREEHEAREGATKTAREQAPEHVELTRKFLREAEERGLYHLEGHRALGGCRASLYTGMPMEGVDALVQFMKEFAEENSDVSSPETKKSRQAA

SEQ ID NO: 1010 - protein, 3385 aa, Neospora caninum
MVHQGASAQPRAEVGKEAAAEPATGCPKRRSPAKSHPPASPQKPGQARTDDRGPWGARDEVGARCDELGVKRELAGIACSVGQADSPCTVYSPSLDGSGERTQSSDHSFRSTRVTPESGDAGRGGDGQDTREETESLSRNELCDLGEETRERRLLRTPSASSGASGASGLALSDEVTDGEEEDVLAAFVKRMGGSHVIRRILIANNGTAAVRCIRSMRHWAYEALGDSKALEFVVMATAADIDANAEFIAEADFYVEVPPGPNSNNYANLHLIVQTAETYECDAVWPGWGHASENHRLPAILRTLKRKTIWIGPSPQAMLALGDKIGSAIIAQSVNVPCVPWSGMDVTVDLSQVDPTKGLSQQTLEAACVQSAKDVLDCCAKIGYPVMIKASEGGGGKGIRRVAGPEEVADAYRQVVNEVKGSPVFVMRMVSECRHLEVQLLADKSGRCVSLGSRDCSIQRRCQKIIEEGPVVAAPPAVVRQMEDAACRMAMAVGYENAGTCEFLYDPNTHQFAFLEVNARLQVEHVVTECVGDFNLPAAQLQVAMGILIDDIPDIKAYLDTAASNKPVRKHIIAARITAEHAEESFRPTVGLVHELTFRPSRFVWGYFSIGSKGNIHAFNDAQFGHLFAHGKDRREAVKHMVLALKDMTIRGELRTNVEALIKILEHPDFVANATHTTWLEEKVNFSSESNDVSPVLLLGVLLAAVFESYTHFRESEEAFVKRVEQGQLPPSISVSYESCLVYRSTKFTLQCTYGGQNTVCVALNDSSTTVHIRRITSAGAGGPGAEQRDGGFLVRGGIDGKSRKVYYKEDSTGLRVSFDGTTYTFTTESDPTQVRPPVSGKLVRWLVANEQNVVKGQSYAEIEIMKMYMQLHVEASGKLMHAMSEGAVFQAGDLLATLELPPGVTVPKATPFRGGFPSSAVSSCEENAQTRGKRLKLAQQREEHQRRQRMLNPLPAYRASREQLVNALDGYQIRQEDEDQAVACFFECILNPMLPISEVKEVLAVIDSQLPELLTTRLRSILADAEARAVAAFGLDEETPSRHSSPSRSSPQARRAHRAASALSLGPLGQTCQEGKSGQAPRAGRQSKLEEQDTTPGTPDGEARPKEDSAKSGRPKTKASKARSLSLASHLPPFLFSFPPFALELPVDECFAAVETQLALQAGGVSAPHATETSGLPEARGAETPHSPPADHAGEYVGVCVSRAQLQPLFECLTKYERGLIMAAAEDIARLLEKYLEVEELFEDSREGAAKSISMKRTEVDSAALASLQRSHQALKRKNRLLARLFEFIRKCPVWQSPVFLQRYMRSYSHFMESLPHLHDCLQRLSTLGGGSPEYSAVSLPARQLMLIKRRKPLEEQVRHVVQRISYLANSTRLVTSPTSALPEPSSSAAAAAAAAAVAASAAAAAAAAASAAAVAANAAGPGAGAGAGAGTGAGAGPGPGGPSGPACSSLNAVGACRSRLAAAAAAAAAATAAVVNLSSPSSPVLLPARHPVAATPTAGGAQLLFSGTGASPVAGGGCFFGSLDELLWDFEGCPDNVLMCLFLHPNDELKRCALQLYISRHYGRHGLHEMRIHTAGEVWEGPYGFLDELSQEKPSPAALPSLPTTKSSSLAPAEDHALPGSFVSATPVPAHAHVSGFSGSPAAYAGAAFLSSFPGEAETPCASSFSSWSLWGSPEVYVQRANPLLAVWTHHAVLTQEFLTETLDQIKPAPAASCTSAAASPAPPSRQGSTAQAFSASSAGALGEQKTPGASSGATALVGEPRPPSSLETEEVRREPRELAATLFRRVSSSVDLACCPSSLSAGKKEDGRRALSPFLAHSLSSLYSPVSAPVPSAARPSSEARIGDCAVASFASVPPSAGRSGGKFDDVDVDGGEAWEALGRASKSRLRHILTCFGGGENDETGRIARSQQTVAMVFDGIYSLENDFVDRLVEYARIHRAMPPPPPTVDGKILQVFILDLGPANAAANKEAHCCSVIAQLLNEAASLLQSCNLHLVAVTLLSSSSPLSPAICGSTSSFHLSSSPSSPASARSPRLLEQAPEAGPAVDEGVGCAPLPSSVLSAFLREHFSENPGDSSDETETPRYFYFRNCYRLPTPAVIAAGRLPGCSLSASPPNSTSSTPSRASSPAPGARGDDGRARGDRGHAPAAVVKALVASSENDRDEANRGPPDGASLPGARLAMRPLPPLCCPSTVAALSPCFEEEDLIRNTSHAQFSLLELSRFLPHFHVRFIPTSVPDVHVFKAVPKPSGSGPRAPGPSPLASAPAAPEERAPNPAPDPPARTAPRQSRAGGSRYFVRILVTVVTGGAAGGRGRGGKETPGDSLGRERDGVEDELDDVLSEQERRFVCGLNALEVACKSGDGDAMAGNHLLLSTTILFPAAAAGPASGARPSRPRTSSTGSVGGGPAGPAQLCSAPTAVVHRVAPGALEAAARKLVNQYERRLAKMNVKKVELRYMQRSIAGSEGPCVPLRLVVDNPTGQSLRIRKFLEVTNPTTGEQVFSALANRGALSLGGAGAFSLHSSLSLPGSRPASEASASLAASRHISVKLGDDSDFDGRPVNVPHPLPSALDVRRAQAFTVSTVFIYDFLDLFEEAIRKQWRSCPKYFLPAIVENTTSAGAARSSSGHGANADSSTAKSFLPERVFEATELRLNRKGELEEVQREKGLNECGMVAWRVTMYTPEFPKGRRVILIGNDVTFQMGTFGVTEDLLFQRASEIARKEGIPRIYIAVNSGARMGLANEVLKLFQVEWIDENQPHRGFKFLYVTEKDYQQLMQTDSIVAEPVQHPVEGTVYKITTIVGAQIGLGVENLCGSGAIAGETARAYKSTFTITFCSGRSVGIGAYLTRLGQRVIQKSVNAPLLLTGYQALNRLIGRDVYSSNDEIGGTDVMHKNGVSHLIVKDDIEGCEAILDWLSYVPEHREGPLPIMVDPTDPVSRPVAYKPARATEDPRLMFTGCIDPQGNWLGGVFDRGSYREAMADWARSVIIGRARLGGIPVGIVAVETRVTEAKQPADPAMPHTSEILLTRAGQVWFPDSAYKTAQAIWDFNQEELPLFIFANWRGFSGGQRDMFNEVLKFGAYIVDALVDYKQPCFVYIPPKGELRGGSWVVVDSRLNAEHMEMYADTESRGGVMEPSGTVEIKFRDKMLIDTMRRLDRVTQQLEKEDAKLASEGLPIDAPRRQEIKEKKEKRIQDLLPVYKQVAIHFADMHDTATRMKKRDAVHDVVVWEKSRNYFYWRLRRQLILFNLRKEITIADPTLTLIQAQHLVFKWAEEAGHNVEGNYQFVQWACHSISFFANKLAALRSAHQMRNLQGFAHDSPTAFLEILRRLDPSLYHRLESVCAVSEQTQSSSSTQRSMAALSLITKPNAPGDNAEPGDSLPASHLL

SEQ ID NO: 1011 - protein, 525 aa, Neospora caninum
MALSPGAVIRVTRLSSLPPLSTVTDVVLSYLEQHLKSAGGFTFSVYPDTSSSPATPFRIAVETKKGEAPRPIAGGEALSDYAAARCVARLAASTGGVFACLLNENGATESADGAVDACEQWAAFCGVPGKTPEAAEHPGLTACIEFFTRRFSTSSAFLCNTPNPSLADMALFALLKTQPAAHTALLSALRTSGEAAKHFSAWSSSIAKALPGATTLSGAGVPDGSAQGNRGEISGATGAGASPESTDGPDATASVNFLKQIVEEDLRTGKHKSVVTRFPPEPNGFLHLGHAKSVCVNFGLAKAFGGRCHLRFDDTNPAKEETRYIESIQRDIKWLGGDWGNHLYYASDYFQQLYDWAELLIKKNLAFVDDDSLEEIRRKRGSISQPGENSPFRERSIEENLDLFRRMRAGEFEEGSRVLRAKIDMTHSNMNMRDPILYRILKKEHPRTGRALAQKTVVLTVFSHVSQKLCASSPSRGISVHSAGRRGTTLPFSASLVHVFCPIEAYIFPPMGVDACESEHTLISI

SEQ ID NO: 1012 - protein, 439 aa, Neospora caninum
MAGTAGSRRFRVPANPGLSYPSWLVPPYAVDDCYFPAPRRNPVCSDAPCFHKEPHSPCTHRAHVESPDSPLNCRQVSPTGYTELCGQTFPSTWDHHPASPCQHVEPSSLDGRLAPHASIEGRAWPVREDHGTGLPPRSLLSRTTQFRRVPGNGSSLQRSTISREKDCGLLLDLKAESRRNHPPESVYTTDYVDHFALTIHPDDTPLEEPQASTAPTWNPSQVTSLREMNGGIQHSCDLPYNPTCSIAQTERSLPHFEPSGIAPCSASRGTAQNLTSTCAVCAPHASETVGCPCPSCWRYGRHQLHLCSLCPEHCSHACVMAPRGAPPGGIVSHSHCGSRAATPMQGIPKTHCWATEIPAGEGTPSGQLRRRSTGTGDQEWQNCKAGRNGVQNGTTPLTTPALGLASFNPRDYKYLPLWELQLVPPAGIPTSKFQPVTRS

SEQ ID NO: 1013 - protein, 349 aa, Neospora caninum
MATNAQPIPELGEFIIANKDKLRNTGQESEMNRLLTAIKLAAKVVNREINKAGLADILGAAGNQNVQGEEQQKLDVFANHKFIQALVNREVVCGICTEEDDDFIEVNRDAHFVMLMDPLDGSSNIDVNVSVGTIFSIYQRVSPLGSPPEMRDFLQPGNAQIAAGYVLYGSSTMLVMTTGDGVNGFTLDPSLGTFFLSHRGMRFPEKARIYSVNEGNYQAFPEGVKKFLEECHDDKTGPFSLRYIGSLVSDFHRNLLQGGIYMYPPTKKDKKGKLRLLYEANPMAFLAEQAGGKATDGFDRIMDIQPSELHQRVPLMIGTARLVDRLDALMAEHSPECRLHASCVGTNNA

SEQ ID NO: 1014 - protein, 321 aa, Neospora caninum
MLEAKLQHASVLRRLFESIKDMVSDVNLDCDDTGLRLQAMDSSHVALVALKLDDVGFVHFRCDRERSLGLNLASVCKVFKLCSNADSCSIQNEEDSDTVTFVFENEADEKLSSFSLRLMAIDQDALRVPEDETAHDVTVKMSAREFANVVRIMGEFSDSVRVEVDKLGVKFVTQGDLGVGEVLLKPKPFANGDDSGVEIQVNSPVCQTYAVKYLNYFAKAASLSSSVTLSLTDQNPIEVRFDILEPAAGAAASAGGDRAGDESQGDEGRAREGRRQTQQPRSCIGHVKFFLAPKMDDDAIGGEDDGGNGDARGMEDSMMDD

SEQ ID NO: 1015 - protein, 690 aa, Neospora caninum
MPSAPLSAAGTGEVGPSVAVPTRGVVQRNMQKPVSLIAAMTPRRGIGVNNGLPWPHLATDFKHFSRVTKTTADEVSRLNAWLPKKIAKTGDSGLPSPAFGVNRFNAVVMGRKTWESLPLKFRPLVDRLNIVVSSSLKEEDIAAEKPLVEGQQRVRVCDSLPAALRLVDEEYRESVDQIYVVGGAGLYEEALSLGVVSHLYITRVARDFPCDVFFPAFPGDSILSNKQAASASQPSAAAEPVFVPFCPQLGREKSNEASYRPIFISKTYSDNGVPYDFVVLEKGRKADACSATESCELRGPWTSTGETSPETRLPSSSASAVAQVLAWMADEDRKKCEKKEIIRAVPHVHFRGHEEFQYLDLIADIINNGATMDDRTGVGVISKFGCTMRFSLDKAFPLLTTKRVFWKGVLEELLWFIRGDTNANHLSEKGVKASLQAPLLSFRLLRRLGAFLRGVTPPRLHAYIECTRLSSRPSAAFAGPRIWDKNVTREFLDSRNLSHREVGDIGPGYGFQWRHFGATYKDMHTDYTGQGVDQLKKVINMLRTNPTDRRMLMTAWNPAALDEMALPPCHLLCQFYVENDRDLSCVMYQRSCDVGLGVPFNIASYSLLTLMVAHVCNLKPKEFIHFMGNTHVYSNHVEALKEQLRREPRPFPIVNILNKERIQEIDDFTAEDFEVVGYVPHGRIQMEMAV

SEQ ID NO: 1016 - protein, 1117 aa, Neospora caninum
MSLSDPRALLDASIPFDDAKVALLDQVVAAMFGTTDNHSRDVAHKVLGEFKNMPEAWSYVAVILNKSQDANTKFVALQILENTIQTRWNVLPDAERNGIKVFVTDLVIRLASDEKACQTEKHFVNKVNENLIQIVKQEWPDRWPGFITEICQSSKASQSICENNMRLLNMLSEEVFDFGRNEMVSKKVDKLMTQLTAQFQEVFDVCMFVLKSYVVNPGGMKESLVQQTLKCLAHFLKWIPLGFVFETDLIETLLQNFWEPVQFRADCLRCITEIASLQLGKEETHMFRERLAVLWLQLVAKVLALPPQTLHFEDAGRVPPQMRLFWETIYCQLSLCLTAFLKNHRENIAEPLDKERNGQACVQMLQQVAAMTDLQHDETFQICLDFWFSFAEKLLNEVHEVLKRQNNGASQPPLMLSMPSSSDPAGGVSGIDALRLPCSSSELSWRVKMYSGVLNEVRKVMIRKMAKPQEVYIQFDQETGEVTRDHEVDTAEVALYNTMRCTQVLLTNLGQEETEAIMLETLNTECMQAPVQLGGWNPTALNRLCYSIGSISGAMREDIERRFLVQVIRNLLNLCELMKGKDDKAIVASNIMYVVGQYPRFLKAHWKFLKTVVYKLFEFMHETFPGVQDMACETFLKVAQKCKQAMAASRQEEPKPFVMEIIEKHTKETEVLDEKQNLLFFEAVAWVVSATSDSLKNECIMGLMQQCNTTWKQIMEAAKANPDQVLYSLDVSKRLVNILRLNQRVAKATGAAFTPQLMVIYQEMIQVYGLYSQRILQEVQRCGPSRIKHSEIKALHLYKRETLHLVETFVDTAAQEGANCRKEIAEKLIGDLLQPVLSDYKNNIPDTRDCEVLTLLSVLMARLDSNISPVLPVIFEFVFDSTLDMIKTDFQSYPDHREKFYELLKVCNQHCFDGLFALPPHQLKAYVESLVWAFKHEHPSVAEQGLQVTYEFLLKLINDKREVLSDFCNLFYFSLMKETLLVLTDTLHRSGFKYQTLIFMHLVRIVEFGVVQNPANGLTRENVIRSFQTVNQKQVEAFVVDLFNYCRDPKPTRFQQHMRDFLISLKEFAGDNDPLFEAEREEALARARELDRQRRMQVPGMIEQYDTTVTVRGGDDD

SEQ ID NO: 1017 - protein, 363 aa, Neospora caninum
MTGDASAPNAGQVKLFAIGNPILDLVAEVPASFLEEFSLKRGEAVLASPEQRRVYVEVEKFNPTRMTGGSALNTSRVAQQLFKMPGSVAYMGAIGDDDRGTQLKDLCDKEGLATRFMVAPGEPTAVCAVLINQKERTLCTDLGACLAFRLPADWETVVRDTRFFYATAYTISASPDNALAVARYAATKPGSVFTLNLSALFCIEVYKDALKTLFPLTNILVGNDEEFAHLARVHDVVAEDKKQMSTQDRDHAVSVCTGALGLLTAGQNAGVTKLAVMTRGESSVIAAESAADGTVVIHEVEVPKVPDEKIVDTNGAGDAFIGGFLYAFAQGRSVRDSIVCGNACARNVIMHEGFAVDFSAFSW

SEQ ID NO: 1018 - protein, 171 aa, Neospora caninum
MKVFKDVFTGDELCSDSYAQLAPMEDADLSEVAFEVATKRVVKGAEDYGIADNSEEDGGGVDSATETVIDVVDAFRLQETPFSKKEFGTYIKGYMQRVKTHLEKTQPDRVDKFMSGGQALVKKILGQFDDFQFFLGESADCEAGVVFAYYKDGEEAPRLIYIRDGLKEEKY

SEQ ID NO: 1019 - protein, 430 aa, Neospora caninum
MASPFTGGLSVWDERLVSSQLAALSTTASPSPAPPAPANQEANSAAVSEKQGGKDKKSSGFVTLYDAVVNGDKWPAPRPSSLSLEEKYQLCLSVAQECIQPEELRSLLEKKPFPLCYDGFEPSGRMHVAQGLLKVTNVNKLTKAGCVFVFWVADWFAMLNNKMNGDLKKIQKVGEYFIEVWKAAGMDMQNVRFLWASEEINRNSDQYWVQVMQIARSFTITRIKRCSQIMGRQEGDEQPAAQIMYPCMQCADIFYLGADICQLGMDQRKVNMLAREYCDEIKRKLKPIILSHQMLPGLLEGQEKMSKSNPDSAIFMEDSEVEVNRKIKKAFCPPGVIDGNPCAVYVEKLIFPAFGEFAVKRSEANGGNVTYATVDEFRNAYIHGELHPGDLKESLARELNRRLEPVRKHFTENEHAKQLLQQIKAYKVTK

SEQ ID NO: 1020 - protein, 247 aa, Neospora caninum
MYRNLYDTDCITWSPQGRIFQVEYAMEAVKQGTCCVGLRSDTHVVLCSLKRSVSKFAGHHQKLFKIDDHVGVAMSGITADAKVISNFMRNECFHHKYVYDAPIPVGRLVLMVADKSQANTQRSGKRPFGVGLLAAGFDDAGPHLFETCPSGNYFESYAMAFGARSQSSKTYLERNFESFPGLSPEELELHAMKALNASLAADAELTADTVSMAIVGKNQPWKELSLDEIQALLDKMNVEPSGEDVQM

SEQ ID NO: 1021 - protein, 2310 aa, Neospora caninum
MPQQRFSTAVGFGRRAEPSSSSSDDEDSREIASFRNRTVGKHGAKLGEEDVWAEVSNSRSQGPPRTSHFHSSPARLEADVSSVVSSRKQGGSTRLQARHAYLNSGGFGAEPGTSEEEETEEEAQDGYYPWPREGESHDRRETQSLPRRRSAATWQRTHDWAETARSGGRYVTGPEEDPSSEDDEEEQSPAYLQDRFARHPQSSSFQRSDSFCGSRSRHSLPSRGNRDGESVASERGRTSSIVEPTVRKLQESSAREVMATVVEPRLKWQKSLKAFQSCLRMEPSEEETVGYESDEEEDTEERPREGLPRGVTAEHAGQRGVRYVSDGGRGPPNLRAYSREDEAEEDQEEKGDEEDSEFARRVAMAAGPRTGRSVQLPSGRGSGDRLQARNPHRDARLARSHWDGEDEDTIYRGENRSRWPRFTATSVSPRSFVGHTPREDSEDEEEQLAELKTYVNKKLSALDRNHGPFRGPRKGAEDEGDEGGRALAPSRKAYRGTLLAALAPGFGTEDDKRSPRSPHFGSADDTDGGEETVSSPSFGAKFPGSSKQQTREMFDKPSEQGATLLSSSRPRLTSQGDADTSSTLTSTPRADTFQLSSPAFPSSFSASFPPSEPVAAKEKIASGFPSRIQQMVGSAEEGEAEEEDGMQYISEEEQEAKLKALQDRYMAKYAELKRAPVLSGNTEDDEEAVEVQISTEETQNEPEGDEESVEQAVEEESACEEQQDGEDENCRDACEEGEGGADGDEDPATEECGEHETVEAEDHQANEDEEETEVNAEETGGDVGEVAEEQDEAVADASPDEPAEECAEEHEAEAGDAKEGEESAQASPPRSGDAEEKDEKSHIKSQVVEALQDVLLSVLRPPSSLPSNSVPHMLPIEAPASSDVSGCAPPTAVAARGLLAALLGRAGSVSSCSDSKEPLALTEISPRGVRENEHLLQSLENPRFASAESILVEAAAGAVMSGTTPRPADMGDGVIRSVLPSPRDHPSAGGPSEAAWKIPSGPAVTSDWSISFLRRGREGDERRRDVSPRGLPVATFPGFSAAKRSSFGQDPRELSPLADVFPPVSGAAIAGGRFAGASSAASFVGETQERLPFDCMRAGQSEEGQALMTHVQLLAGLSGGFQADKSAVTAPYSSMPGPPEGQKLPQEEEERSSPETDRPPQIPSTDDSPPSSFPSSSVASRAFPPVVRALSEARLTTRLGGRLSASLTGTGKKGNKDRDGQAGTETAPGTGVARRTSMECPAKRDRLSEIRRQLKERAGCQEGKPSGEPLPVCPSSSDVFERLCASRPTTPRETATPRRHAQSFFSFDGLEAVPFPALGELKRQLVSQQRGPEEDLLTGKGAGSADILALLAGSTRRVKSGLPVPPPGRPRHSGWSETETGKTKTHGPKADRTGQKSSDVSQDLPSWIELSPDSRTGSSVALCTTTAGGSSPRGRERTVSGEDTFEDEEQDEVEEDETRSCASRTKAGGSSKRGAEAEKKGEKKRKEEARGEVGEQGRTESKRLADKATGGKGRRGLDKRKVAEAAYQSEAEQTFRPTTPSGGDRRSPAIVGHSKRSRREKKERDTRHFSSPRDTHAIVEAHAKGEVTADEESEATRKLQEAQKRQQEMEARTEEQTLLLTAAQKHVQEVHKELERLARENSTLQEEKQQQELKVRQIMKSASRTNLQLLALKAQQPAWERLKKSEEQHHELEALEKELESLKKSVLERTSREHGTIVDLRGRLAATEQLLKERTEAMDRRQAEGEAERRTREALSMQVEEWRVRHEAQTETLRRLTARLGAAEQAKTQLENKLADMLKLMERVKAALVATRNEAAEHKRARESAEKELIWKHAKSVSCAVQTETTGVKHSGMQADLKSSEKNVTTVGVQVGHPTEKSLLGEQDHAREQKLASALAKQKQLTMQVRSEHKKRASAWSAEKAELQAFVISLQGRIAELEKIQKLAMGSKSSVNPPLVPYHMNPFPVGCAPPISSLCPPGMAVASSFAATPFPLPPVSHVPQTLREGAKERDTGRQGARRNGLLSAEADAPEFAEQEEQALLDFVSDLIQTEDAVEAREGDGRVAKGKEHDEPEGQQPRRREDARDTIAADLRAMGETVRVLEDQLDERLRILGTLEDEELDAQGENRGETEAAKKVESAGGVAWSIDEKHSSSEKSLRSGAHSALSASPRTVPGTAQSRSKEASVSCSVSSRLSPVGRIDSLLATPLDSPHVDAGLSALEETGTADRSFPGANGKDASDFMRRGIDQILANKNATSPTARVPQTSLSGGKNPYDSIAHLLTESRRENRATSSAREKVQELRRQLREHGVLS

SEQ ID NO: 1022 - protein, 1737 aa, Neospora caninum
MEALRAGSRQHPSSNIRNVCILAHVDHGKTCLSDRLLSVNGLISEASAGKVRYLDSREDEQRRQITIKASVVSLFFRRPDPDANGAEPERSPGPSSSRCCASRSSPATSADAGGAPAPQEADASSQCTSGSPQDGGRSPRAEAAKPDGLARHVPCYVVNLVDCPGHVDFASEVSAAVRLCDGCLLLVDAVEGVGPQTVAALQQAWNERVVPLLVLTKIDKLIQKLCLTPSEAYAHCQAIIEQVNAHLHQQIHSEFIAATPAFPADSALEEEEACPGTGSESPTGGTQGDQEVNAKASKAGGEAAKSAGLFACHGDPSGEFVYFRGDVEEKLEFHPARGNVLFVSSLHGWCLHLPSFARQNLLGLLQLPLAVLPRLLPALWGDFYLKRTSKASAGAQTVSASSASSSEKSRTEGAGFEIRKAPAFARQPRIVEQLVLGNIWKVYEAAASPATGQGSGSSGRAAGEKLERLWKMIDALEIPASSKACVKAEVKHIVAVQSQVLLGGRGSRERGARGDDGSALGERADEDLTEDIVKAIMTRWLPVGETVLGVIVDRIPNPLSAARQRLAYLCPSFQRTLGGPVGPQLLRLQREQMKALAVKSEIPEASETPPGKVRREPPSSPDASCRSLGSRPEACFAKPPLVLLHVAKFLAADQKMLRLTGDRLQGAEHFSGFVGLCRVFVGTLRRGAVLYVCTENSADDLEGLGGELLSGKSLASGHGTEEGEASGSLTGSGAGGPETGSPGARSGTREAFSVRQIYVLFGQDLKPIDAAASGSVVAVSLRPRKKKGVAKAWERSGNPASDRPVGSPSGVHTAEKSAREGDGSKPEKKAFEEFLGAERDEAPTDESESSDEESEESVRDVTAWLQSLRDRNRPLLLQHQGGFFSSPAGVGSACAGPGHVAGVTSLHRCVTLSSWPTCPSLLTPYSKASSAIVRVAVEPQRLEDAQQFVKGMARLYVADPSIELSVLDSGEFLMGCCGEVHLETCLRDLQGLYAEVPITISPPMVAIRETLAPFASLSRSGDASAGLASAGPASGIAPHNVFCSVSLRIPFPPWAKAPLLHPGASASAAAPFPAFASPAGTLPGASADNAAWCPSGTGADLAATFASPEASDGRALLPSRAPVNGFASSPFAPAFETQPQSPQAARDCAGSLASGAAVDRGEGERQGGGRGGEDAVAAWLAKRATELQPEGVCAWTAGHQLGILLRAEPMPPEVTTWLTDASREINAVLKSRVPSRRFLRSEDLRSSPGDSDPAAPASSGARPGGASAAGSLNAPNLLQEAMERIAAAFRAEWVHSGRRCPSQEPAQGGPDCGPEPESAGAASPSTGQRFGPSAREQGSASSRGGAPEGRTPFPGHLWGLALSAGACTALLASHACRLVVPSSPSSGDSGAGSAGGEKRGATPAEGRVDGTPGGARGGQGGDKTDSAPPGWRELRGLEEWRLAHSYGADAVAWASDSSGAVLKRVVPALVSGFELASLSGPLAEERVRGVAFIVEALVYHSPSLGSAAGGSCASSPSGTRRAGASRVLDAVPGGKEEFFADTASLASVDSASRTLCSANSGMPYGPFSGQAMSTMKEACRRALLQRGRCRIYEAMIRFTLTCEQRVLGKVYGVLSRRRSKIYKEGLLDGQTSLFVVDGCLPTSEAVGIARELRSKASGHVSLQMQFSHWEILDEDPFPEACMTEEELEDEGVAGVAALASQICARRIINSIRKTKGLPTEEKVVAAAEKQRTLTRNK

The invention claimed is:
1. An enriched antigen extract composition, comprising: the following proteins having the amino acid sequences of SEQ ID NOs: 45, 58, 60, 76, 80, 87, 120, 121, 140, 156, 176, 177, 185, 188, 229, 246, 247, 285, 289, 307, 315, 318, 322, 323, 347, 362, 382, 390, 397, 440, 453, 459, 463, 486, 491, 519, 540, 560, 570, 577, 633, 636, 680, 716, 769, 785, 886, 887, 895, 897, 899, 902, and 1022, wherein each protein is present in an amount at least about 2 fold change higher than the same protein present in a whole tachyzoite extract, as calculated by quantitative label-free liquid chromatography-tandem mass spectrometry (LC-MS/MS);

wherein the enriched antigen extract composition is produced according to a method comprising the following steps;
(a) centrifuging a hypertonic solution of *Neospora* cells to separate the soluble fraction and insoluble fraction, wherein the centrifugation takes place at a centrifugal force ranging from about 8.000×g to about 15.000×g, for a time ranging from about 40 minutes to about 90 minutes and at a temperature ranging from about 1° C. to about 10° C.;
(c) recovering the insoluble fraction from step (b);
(d) mixing the recovered insoluble fraction with a non-ionic surfactant; and
(e) homogenizing the mixture of step (d) to yield the enriched antigen extract;
wherein the whole tachyzoite extract is prepared by direct resuspension of $10^8$ frozen tachyzoites of the Nc-Spain 7 isolate of *N. caninum*, with accession number CCAP 2051/1, in 100 μl of 1% Triton-X 100 (v/v);
and an adjuvant.

2. The enriched antigen extract composition according to claim 1, wherein the enriched antigen extract composition comprises the following proteins in an amount having the following fold change as compared to the amount of the same protein that is present in the whole tachyzoite extract:

NCLIV_018120 (SEQ ID NO:177) at about 4.15 fold change higher;
NCLIV_003410 (SEQ ID NO:886) at about 3.35 fold change higher;
NCLIV_058550 (SEQ ID NO:347) at about 3.33 fold change higher;
NCLIV_042610 (SEQ ID NO:897) at about 3.06 fold change higher;
NCLIV_032910 (SEQ ID NO:382) at about 2.99 fold change higher;
NCLIV_024830 (SEQ ID NO:519) at about 2.7 fold change higher;
NCLIV_015180 (SEQ ID NO:323) at about 2.52 fold change higher;
NCLIV_066970 (SEQ ID NO:453) at about 2.48 fold change higher;
NCLIV_025730 (SEQ ID NO:560) at about 2.47 fold change higher;
NCLIV_006640 (SEQ ID NO:289) at about 2.42 fold change higher;
NCLIV_003470 (SEQ ID NO:887) at about 2.39 fold change higher;
NCLIV_01900) (SEQ ID NO:390) at about 2.37 fold change higher;
NCLIV_054510 (SEQ ID NO:785) at about 2.36 fold change higher;
NCLIV_066350 (SEQ ID NO:577) at about 2.35 fold change higher;
NCLIV_057020 (SEQ ID NO:902) at about 2.32 fold change higher;
NCLIV_056680 (SEQ ID NO:246) at about 2.3 fold change higher;
NCLIV_044290 (SEQ ID NO:463) at about 2.29 fold change higher;
NCLIV_032030 (SEQ ID NO:680) at about 2.27 fold change higher;
NCLIV_052240 (SEQ ID NO:362) at about 2.27 fold change higher;
NCLIV_008730 (SEQ ID NO:318) at about 2.22 fold change higher;
NCLIV_061830 (SEQ ID NO:120) at about 2.22 fold change higher;
NCLIV_002770 (SEQ ID NO:440) at about 2.18 fold change higher;
NCLIV_014760 (SEQ ID NO:636) at about 2.17 fold change higher;
NCLIV_054520 (SEQ ID NO:322) at about 2.17 fold change higher;
NCLIV_033810 (SEQ ID NO:716) at about 2.16 fold change higher;
NCLIV_043330 (SEQ ID NO:121) at about 2.16 fold change higher;
NCLIV_000430 (SEQ ID NO:486) at about 2.15 fold change higher;
NCLIV_030860 (SEQ ID NO:176) at about 2.14 fold change higher;
NCLIV_048570 (SEQ ID NO:58) at about 2.14 fold change higher;
NCLIV_004190 (SEQ ID NO:76) at about 2.13 fold change higher;
NCLIV_019450 (SEQ ID NO:459) at about 2.13 fold change higher;
NCLIV_027160 (SEQ ID NO:185) at about 2.13 fold change higher;
NCLIV_044600 (SEQ ID NO:633) at about 2.13 fold change higher;
NCLIV_000300 (SEQ ID NO:307) at about 2.12 fold change higher;
NCLIV_046830 (SEQ ID NO:540) at about 2.12 fold change higher;
NCLIV_004280 (SEQ ID NO:315) at about 2.11 fold change higher;
NCLIV_006720 (SEQ ID NO:229) at about 2.1 fold change higher;
NCLIV_046800 (SEQ ID NO:188) at about 2.1 fold change higher;
NCLIV_051960 (SEQ ID NO:769) at about 2.1 fold change higher;
NCLIV_010600 (SEQ ID NO:45) at about 2.09 fold change higher;
NCLIV_015920 (SEQ ID NO:87) at about 2.09 fold change higher;
NCLIV_012830 (SEQ ID NO:285) at about 2.08 fold change higher;
NCLIV_0376 (SEQ ID NO:1022) at about 2.08 fold change higher;
NCLIV_024420 (SEQ ID NO:140) at about 2.06 fold change higher;
NCLIV_036130 (SEQ ID NO:570) at about 2.06 fold change higher;
NCLIV_036400 (SEQ ID NO:156) at about 2.06 fold change higher;
NCLIV_006780 (SEQ ID NO:397) at about 2.04 fold change higher;
NCLIV_046940 (SEQ ID NO:899) at about 2.04 fold change higher;
NCLIV_001370 (SEQ ID NO:491) at about 2.03 fold change higher;
NCLIV_001300 (SEQ ID NO:60) at about 2.02 fold change higher;
NCLIV_015380 (SEQ ID NO:80) at about 2.02 fold change higher;
NCLIV_038990 (SEQ ID NO:895) at about 2 fold change higher; and
NCLIV_043110 (SEQ ID NO:247) at about 2 fold change higher.

3. The enriched antigen extract composition according to claim 1, wherein the composition comprises the following proteins: NCLIV_018120 (SEQ ID NO:177), NCLIV_003410 (SEQ ID NO:886), NCLIV_058550 (SEQ ID NO:347), NCLIV_042610 (SEQ ID NO:897), NCLIV_032910 (SEQ ID NO:382), NCLIV_024830 (SEQ ID NO:519), NCLIV_015180 (SEQ ID NO:323), NCLIV_066970 (SEQ ID NO:453), NCLIV_025730 (SEQ ID NO:560), NCLIV_006640 (SEQ ID NO:289), NCLIV_003470 (SEQ ID NO:887), NCLIV_019000 (SEQ ID NO:390), NCLIV_054510 (SEQ ID NO:785), NCLIV_066350 (SEQ ID NO:577), NCLIV_057020 (SEQ ID NO:902), NCLIV_056680 (SEQ ID NO:246), NCLIV_044290 (SEQ ID NO:463), NCLIV_032030 (SEQ ID NO:680), NCLIV_052240 (SEQ ID NO):362), NCLIV_008730 (SEQ) ID NO:318), NCLIV_061830 (SEQ ID NO:120), NCLIV_002770 (SEQ ID NO:440), NCLIV_014760 (SEQ ID NO:636), NCLIV_054520 (SEQ ID NO:322), NCLIV_033810 (SEQ ID NO:716), NCLIV_043330 (SEQ ID NO:121), NCLIV_000430 (SEQ ID NO:486), NCLIV_030860 (SEQ ID NO:176), NCLIV_048570 (SEQ ID NO:58), NCLIV_004190 (SEQ ID NO:76), NCLIV_019450 (SE ID NO:459), NCLIV_027160 (SEQ ID NO:185), NCLIV_044600 (SEQ ID NO:633), NCLIV_000300 (SEQ ID NO:307), NCLIV_046830 (SEQ ID NO:540), NCLIV_004280 (SEQ ID NO:315), NCLIV_006720 (SEQ ID NO:229), NCLIV_046800 (SEQ ID NO:188), NCLIV_051960 (SEQ ID NO:769), NCLIV_010600 (SEQ ID NO:45), NCLIV_015920 (SEQ ID NO:87), NCLIV_012830 (SEQ ID NO:285), NCLIV_0376 (SEQ ID NO:1022), NCLIV_024420 (SEQ ID NO):140), NCLIV_036130 (SEQ ID NO:570), NCLIV_036400 (SEQ ID NO:156), NCLIV_006780 (SEQ ID NO:397), NCLIV_046940 (SEQ ID NO:899), NCLIV_001370 (SEQ ID NO:491), NCLIV_001300 (SEQ ID NO:60), NCLIV_015380 (SEQ ID NO:80), NCLIV_038990 (SEQ ID NO-895), NCLIV_043110 (SEQ ID NO:247), NCLIV_004750 (SEQ ID NO:416), NCLIV_025000 (SEQ ID NO:511), NCLIV_041790 (SEQ ID NO:299), NCLIV_058420 (SEQ ID NO:740), NCLIV_015430 (SEQ ID NO:25), NCLIV_023620 (SEQ ID NO:327), NCLIV_049050 (SEQ ID NO:127), NCLIV_029420 (SEQ ID NO:179), NCLIV_010320 (SEQ ID NO:95), NCLIV_006060 (SEQ ID NO:380), NCLIV_032810 (SEQ ID NO:894), NCLIV_004860 (SEQ ID NO:226), NCLIV_007260 (SEQ ID NO:24), NCLIV_026590 (SEQ ID NO:893), NCLIV_054540 (SEQ ID NO:629), NCLIV_0153 (SEQ ID NO:889), NCLIV_030420 (SEQ ID NO:107), NCLIV_051920 (SEQ ID NO:872), NCLIV_065970 (SEQ ID NO:407) NCLIV_026430 (SEQ ID NO:457), NCLIV_061160 (SEQ ID NO:78), NCLIV_070010 (SEQ ID NO:1), NCLIV_036300 (SEQ ID NO:760), NCLIV_057950 (SEQ ID NO:158), NCLIV_038320 (SEQ ID) NO:254), NCLIV_040600 (SEQ ID NO:553), NCLIV_030820 (SEQ ID NO:228), NCLIV_034990 (SEQ ID NO:442), NCLIV_037520 (SEQ ID NO:154), NCLIV_054120 (SEQ ID NO:231), NCLIV_061210 (SEQ ID NO:496), NCLIV_010650 (SEQ ID NO:730), NCLIV_026340 (SEQ ID NO:669), NCLIV_013150 (SEQ ID NO:200), NCLIV_055360 (SEQ ID NO:6), NCLIV_066600 (SEQ ID NO:189), NCLIV_015790 (SEQ ID NO:492), NCLIV_055730 (SEQ ID NO:245), NCLIV_067140 (SEQ ID NO:26), NCLIV_007800 (SEQ ID NO:40), NCLIV_008850 (SEQ ID NO:74), NCLIV_028110 (SEQ ID NO:581), NCLIV_065470 (SEQ ID NO:86), NCLIV_040650 (SEQ ID NO:896), NCLIV_041830 (SEQ ID NO:368), NCLIV_050590 (SEQ ID NO:81), NCLIV_051010 (SEQ ID NO:389), NCLIV_058800 (SEQ ID NO:903), NCLIV_003190 (SEQ ID NO:427), NCLIV_042820 (SEQ ID NO:3), NCLIV_058840 (SEQ ID NO:438), NCLIV_020980 (SEQ ID NO:892), NCLIV_032050 (SEQ ID NO:244), NCLIV_053290 (SEQ ID NO:248), NCLIV_060220 (SEQ ID NO:211), NCLIV_061940 (SEQ ID NO:455), NCLIV_003650 (SEQ ID NO:436), NCLIV_006290 (SEQ ID NO:888), NCLIV_016800 (SEQ ID NO:49), NCLIV_034130 (SEQ ID NO:68), NCLIV_052350 (SEQ ID NO:129), NCLIV_054570 (SEQ ID NO:249), NCLIV_055850 (SEQ ID NO:160), NCLIV_015480 (SEQ ID NO:381), NCLIV_015950 (SEQ ID NO:890), NCLIV_030620 (SEQ ID NO:283), NCLIV_041210 (SEQ ID NO:536), NCLIV_047860 (SEQ ID NO:30), NCLIV_054250 (SEQ ID NO:371), NCLIV_058890 (SEQ ID NO:37), NCLIV_070060 (SEQ ID NO-284), NCLIV_003580 (SEQ ID NO:539), NCLIV_005620 (SEQ ID NO:166), NCLIV_036700 (SEQ ID NO:62), NCLIV_056570 (SEQ ID NO:901), NCLIV_059730 (SEQ ID NO:904), NCLIV_008230 (SEQ ID NO:334), NCLIV_015410 (SEQ ID NO:97), NCLIV_032390 (SEQ ID NO:91), NCLIV_033780 (SEQ ID NO:321), NCLIV_036610 (SEQ ID NO0194), NCLIV_045300 (SEQ ID NO:898), NCLIV_049830 (SEQ ID NO:557), NCLIV_055760 (SEQ ID NO:155), NCLIV_058440 (SEQ ID) NO:72), NCLIV_064840 (SEQ ID NO:398), NCLIV_038360 (SEQ ID NO:48), NCLIV_043760 (SEQ ID NO:227), NCLIV_052270 (SEQ ID NO:794), NCLIV_027850 (SEQ ID NO:547), NCLIV_011960 (SEQ ID NO:667), NCLIV_018530 (SEQ ID NO:125), NCLIV_022690 (SEQ ID NO:758), NCLIV_024630 (SEQ ID NO:122), NCLIV_027530 (SEQ ID NO:337), NCLIV_045600 (SEQ ID NO:618), NCLIV_001970 (SEQ ID NO:18), NCLIV_011410 (SE II NO:10), NCLIV_014360 (SEQ ID NO:198), NCLIV_019110 (SEQ ID NO:2), NCLIV_030070 (SEQ ID NO:652), NCLIV_014430 (SEQ ID NO:485), NCLIV_042410 (SEQ ID NO:96), NCLIV_043930 (SEQ ID NO:199), NCLIV_061560 (SEQ ID NO:533), NCLIV_025670 (SEQ ID NO:39), NCLIV_027930 (SEQ ID NO:564), NCLIV_028540 (SEQ ID NO:251), NCLIV_064260 (SEQ ID NO:906), NCLIV_069590 (SEQ ID NO:145), NCLIV_013360 (SEQ ID NO:630), NCLIV_040540 (SEQ ID NO:297), NCLIV_040970 (SEQ ID NO:293), NCLIV_056670 (SEQ ID NO:215), NCLIV_067010 (SEQ ID NO:116), NCLIV_004140 (SEQ ID NO:528), NCLIV_028750 (SEQ ID NO:240), NCLIV_031780 (SEQ ID NO:31), NCLIV_035190 (SEQ ID NO:578), NCLIV_050470 (SEQ ID NO:101), NCLIV_051560 (SEQ ID NO:384), NCLIV_054800 (SEQ ID NO:220), NCLIV_064950 (SEQ ID NO:130), NCLIV_011700 (SEQ ID NO:192), NCLIV_012920 (SEQ ID NO:69), NCLIV_024030 (SEQ ID NO:305), NCLIV_030890 (SEQ ID NO:281), NCLIV_032780 (SEQ ID NO:181), NCLIV_060140 (SEQ ID NO:253), NCLIV_065210 (SEQ ID NO:44), NCLIV_069460 (SEQ ID NO:717), NCLIV_001660 (SEQ ID NO:580), NCLIV_016540 (SEQ ID NO:230), NCLIV_028680 (SEQ ID NO:149), NCLIV_032830 (SEQ ID NO:792), NCLIV_055490 (SEQ ID NO:7), NCLIV_056560 (SEQ ID NO:852), NCLIV_066840 (SEQ ID NO:16), NCLIV_031770 (SEQ ID NO:147), NCLIV_047810 (SEQ ID NO:139), NCLIV_060660 (SEQ ID NO:208), NCLIV_006490 (SEQ ID NO:326), NCLIV_020840 (SEQ ID NO:21), NCLIV_028090 (SEQ ID NO:303), NCLIV_040440 (SEQ ID NO:296), NCLIV_044200 (SEQ ID NO:146), NCLIV_051110 (SEQ ID NO:611), NCLIV_053940 (SEQ ID NO:567), NCLIV_055720 (SEQ ID NO:151),

NCLIV_068850 (SEQ ID NO:90), NCLIV_019520 (SEQ ID NO:891), NCLIV_020720 (SEQ ID NO:163), NCLIV_022950 (SEQ ID NO:260), NCLIV_031670 (SEQ ID NO:84), NCLIV_032110 (SEQ ID NO:201), NCLIV_056300 (SEQ ID NO:377), NCLIV_063370 (SEQ ID NO:425), NCLIV_007770 (SEQ ID NO:157), NCLIV_036570 (SEQ ID NO:601), NCLIV_051840 (SEQ ID NO:403), NCLIV_052390 (SEQ ID NO:115), NCLIV_062890 (SEQ ID NO:449), NCLIV_003050 (SEQ ID NO:19), NCLIV_004810 (SEQ ID NO:698), NCLIV_021080 (SEQ ID NO:92), NCLIV_000940 (SEQ ID NO:221), NCLIV_010730 (SEQ ID NO:88), NCLIV_014950 (SEQ ID NO:466), NCLIV_020920 (SEQ ID NO:632), NCLIV_037190 (SEQ ID NO:98), NCLIV_048380 (SEQ ID NO:900), NCLIV_049900 (SEQ ID NO:5), NCLIV_056430 (SEQ ID NO:124), NCLIV_060730 (SEQ ID NO:46), NCLIV_062940 (SEQ ID NO:271), NCLIV_064490 (SEQ ID NO:907), NCLIV_012230 (SEQ ID NO:516), NCLIV_015260 (SEQ ID NO:606), NCLIV_017840 (SEQ ID NO:640), NCLIV_023790 (SEQ ID NO:332), NCLIV_057710 (SEQ ID NO:656), NCLIV_061040 (SEQ ID NO:264), NCLIV_025600 (SEQ ID NO:761), NCLIV_0260 (SEQ ED NO:402), NCLIV_033250 (SEQ II) NO:206), NCLIV_048040 (SEQ ID NO:499), NCLIV_059960 (SEQ ID NO:905), NCLIV_066020 (SEQ ID NO:17), NCLIV_070170 (SEQ ID NO:908), NCLIV_012400 (SEQ ID NO:386), NCLIV_036830 (SEQ ID NO:109), NCLIV_041120 (SEQ ID NO:311), NCLIV_053880 (SEQ ID NO:298), NCLIV_025920 (SEQ ID NO:59), NCLIV_033680 (SEQ ID) NO:262), NCLIV_043270 (SEQ ID NO:42), NCLIV_064530 (SEQ ID NO:394), NCLIV_015210 (SEQ ID NO:118), NCLIV_019830 (SEQ ID NO:501), NCLIV_025450 (SEQ ID NO:287), NCLIV_048050 (SEQ ID NO:649), NCLIV_049080 (SEQ ID NO:797), NCLIV_058450 (SEQ ID NO:638), NCLIV_003310 (SEQ ID NO:142), NCLIV_026600 (SEQ ID NO:306), and NCLIV_040040 (SEQ ID NO:863).

4. A pharmaceutical composition, comprising the enriched antigen extract composition according to claim 1, one or more pharmaceutically acceptable carriers or diluents.

5. The pharmaceutical composition according to claim 1, wherein the adjuvant is a saponin.

6. The pharmaceutical composition according to claim 4, wherein the pharmaceutical composition comprises an amount ranging from 0.0001% to about 0.5% w/v of the enriched antigen extract composition.

7. A method of treating or preventing infections caused by *Neospora*, comprising administering to a mammal in need thereof a pharmaceutical composition of claim 4.

8. The method according to claim 7, wherein the mammal is selected from the group consisting of canidaes and ungulates.

9. The method according to claim 7, wherein the pharmaceutical composition is administered to the mammal in an amount of about 0.001 µg to about 10 µg per kg of the mammal.

10. The pharmaceutical composition according to claim 5, wherein the saponin is spijoside.

11. The method according to claim 9, wherein the pharmaceutical composition is administrated to the mammal at least two times and at least about 14 to about 21 days between each of administration.

12. The method according to claim 9, wherein the pharmaceutical composition is administered by a route selected from the group consisting of intranasally, intradermally, subcutaneously, by aerosol, intramuscularly, wing web, eyedrop administration, and any combination thereof.

13. The enriched antigen extract composition according to claim 1, wherein the *Neospora* cells belong to the species *Neospora caninum*.

14. The enriched antigen extract composition according to claim 1, wherein the hypertonic solution comprises sucrose and/or sorbitol and/or mannitol.

15. The enriched antigen extract composition according to claim 1, wherein the centrifugation takes place for about 60 minutes at a temperature of about 4° C.

16. The enriched antigen extract composition according to claim 1, wherein the non-ionic surfactant is selected from the group consisting of Polysorbate 80, Triton X-114, Triton X-100, and Tween 20.

* * * * *

UNITED STATES PATENT AND TRADEMARK OFFICE
CERTIFICATE OF CORRECTION

PATENT NO. : 10,864,260 B2
APPLICATION NO. : 15/771832
DATED : December 15, 2020
INVENTOR(S) : Javier Regidor Cerrillo et al.

It is certified that error appears in the above-identified patent and that said Letters Patent is hereby corrected as shown below:

In the Claims

Column 135, Claim 1, Line 7:
"force ranging from about 8.000xg to about 15.000xg," should read -- force ranging from about 8,000xg to about 15,000xg, --.

Column 137, Claim 3, Line 12:
"(SEQ ID NO): 362)" should read -- (SEQ ID NO:362) --.

Column 137, Claim 3, Line 13:
"(SEQ) ID NO: 318)" should read -- (SEQ ID NO:318) --.

Column 137, Claim 3, Line 20:
"(SE ID NO:459)" should read -- (SEQ ID NO:459) --.

Column 137, Claim 3, Line 29:
"(SEQ ID NO): 140)" should read -- (SEQ ID NO:140) --.

Column 137, Claim 3, Line 34:
"(SEQ ID NO-895)" should read -- (SEQ ID NO:895) --.

Column 137, Claim 3, Lines 51-52:
"(SEQ ID) NO:254)" should read -- (SEQ ID NO:254) --.

Column 138, Claim 3, Line 15:
"(SEQ ID NO-284)" should read -- (SEQ ID NO:284) --.

Column 138, Claim 3, Line 22:
"(SEQ ID NO0194)" should read -- (SEQ ID NO:194) --.

Signed and Sealed this
Twelfth Day of July, 2022

Katherine Kelly Vidal
*Director of the United States Patent and Trademark Office*

CERTIFICATE OF CORRECTION (continued)
U.S. Pat. No. 10,864,260 B2

Column 138, Claim 3, Lines 24-25:
"(SEQ ID) NO:72)" should read -- (SEQ ID NO:72) --.

Column 138, Claim 3, Line 33:
"(SE II NO:10)" should read -- (SEQ ID NO:10) --.

Column 139, Claim 3, Lines 23-24:
"(SEQ ED NO:402)" should read -- (SEQ ID NO:402) --.

Column 139, Claim 3, Line 24:
"(SEQ II) NO:206)" should read -- (SEQ ID NO:206) --.

Column 139, Claim 3, Line 31:
"(SEQ ID) NO:262)" should read -- (SEQ ID NO:262) --.